United States Patent 7,745,391 (HUMAN THROMBOSPONDIN POLYPEPTIDE) - sequence listing, part 19

SEQ ID NO: 47086 - DNA, 1153 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggagggaattgaaaacaaggaattccccaaccaaacaggggcacaggctgtgtttgcagctcctgtaaaagctccatacccagagccgtgtctcccagctcccagccgtctttgtggcaattctacattggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg

SEQ ID NO: 47087 - DNA, 1113 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggactccgggaagaggtgcacgaactgcaggcgcggtggttccccagcagaaccactctgcatcgccgtctttgtggcaattctacattggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg

SEQ ID NO: 47088 - DNA, 385 bp, Homo sapiens
taataagtacaaagtgggcagaccaagggaggagatagtcctgtatctgcttagttacaaccctgcatgttggaatacattgataaactggcagatataggaagaaagtgagcaaagttgtgtagtggtcagaaatcctctcttgcgagaaacaattgaagcaaccaatttcattcatcctggagatgaatttacttgggagaaccatgttaaatacctttggagttttaaatgactggtatgtaggcaaggggctgagtattaatgtaatgtcagaaggctgaagaagttccaatgtggtgtgtggtcaccaaaatgcagattgcagatcagtttagagaattttcagcaggttcatctaaacttcgtatttctggtgcctcca

SEQ ID NO: 47089 - DNA, 441 bp, Homo sapiens
gacatctataattattgaaaaatatatttctggaaagagttgcaaagttgcatttttttgcctttcccattgcttctagcccaggatactgtcgctccagaactgcatttgaggcaagcttggttccaccatggaagggagagtcaggtggtgaaattccacctagtctgtggtcctaaatgagggggtgggggattttgggggagaacagaaattactgtgccagcaaagggagattagaaaacatctgtaggtgtgaatgcagatgtcgagggaaaaatgatttggttccccattagaagggtaactggctaaaatgcaaactcgaactatactgagatgctgtttctcaactatgggattggtaaacatgaaaaagtttgacaacacattctatggtaaggctggagtaagtgtcactttgtgcattgctagtgggag

SEQ ID NO: 47090 - DNA, 748 bp, Homo sapiens
gcagctacctctctaaagagccctctccttttaacactggttcccagattttcccatttatctcacagcagcaggagtcacagctgggttcaatctctgcacgccaccatcaccgcccctcccccaaagttgtagaaatgttattctaaatttaaaccacacagcaccaaactaaaaatggctttaaaagaggatcaaacataccttgtgctgggctcttgttagatttcacaggcacgaatttccctttttctcagcatatgcagtcaaatgattcttaggtgatgaaacaagtatctccaggtttgcaggaaataaaagtgtctgtttttaaactgccatggggaaggggatggaggagggcagaaagagtagggagtgaagtgctgactcgcaggatacatctgggattctgagaatgtcgcccagctccaatgttagcgcatgccagattcttccccacccctttcctgatcaatgagttaggaaagtcagatgaactaggagtcagaaggcctgagtacaagtcctggttatgagacattcccccagtccccaggtaatttttccttcccaagcttcaattccctcgtccataacatgaagaggctgaacttgatcagaggttctcaagctttctttctctttggcactttctttgttactctatcagtaaaaagttcattttctttattaaagtataacagacatactgaaacgtgaacaaaccatgtgctgagctccagga

SEQ ID NO: 47091 - DNA, 256 bp, Homo sapiens
agtaattgagaaagtattatacagatatttaaacaaaggattcagcactacgtaataataatgtaccagttttgtttcagctctttcaagtttttaaaatttgtacctttggtttttctttgtattctggttccttgaggatgtgtagttttttagatctccattttccatgtctgtcatcttctctcagtatctttgcattctggtaaagcttcttaggtttaatctctgtagccacatcagtagttcttttcct

SEQ ID NO: 47092 - DNA, 429 bp, Homo sapiens
agaaagaaaagtattaaaaaggatgacagaaaaagaaaagagatcctctcctggttgtgaatatcaaaagcccaaggacaattcacagccatacaaggccttattgtgacaacactagtaaatgcataaaaactttaagaaaatgttttcgacagtgaaattattgcaggcttttagatattgagaacctatctgtgaaactgaactatataaataattaatagtaagaaaaataaagctcatgtttttctacagaaattgaatgaattatagaaatttgagaaggtgttaacagtcttgaaaatatgaattctttgggttttgcatttccaatgtgcaaaagtggtgtgagatatttcaaccagtctgtcaaataatctgtgcataaattggagagagcagttcccctgaaagagttgctttatatta

SEQ ID NO: 47093 - DNA, 659 bp, Homo sapiens
cttgagttaagcagaagataagattgcctgcctcaggtgctgcagtcaggcccagagcagcagagcagcagcctcaggcctgactagagattgcttgccctcccatcacacacttggagttgcccatttatctgtgtgtccaccatctttacagttgctctcacacacagcagtcattatggaacacctgttctgggcaagacactttgctaattatatattttttctcatttaattctcacaatgagtcctgcaagattgatactaactccaaagccacaaagctgatagccaacacagctgtaatttaaagtagagtctttctaattccaaagcctgtgtcgtttccactaaaccagtattactcaacttttaaacattgtgacctcttttgataaacaggaaagttttgtttcttctctcactcgcagattcagaagaccttcatgtcccatccctgcccgttgcctaggagggcataaacctaatttaggatccctgtatgattaacgtatcccactcagccaagattttgtctagcttgactttcaatagttcatattacaaaattatgattttttttaatttttaaaatataaagttgtattatgacattgcctgttttttttccaaactaaatataccatcaacaagggtat

SEQ ID NO: 47094 - DNA, 707 bp, Homo sapiens
tgagggctcggggtgtctcaagcattaggcagagaaaactgaggtggcttaaggtcactgtgtttcagcagttgaatgttttcattatttatctgtgtcctttttggtgtgtgtgtgtgtgtggtttttttgtttgtttgtttttggttagtatttggtaccatatagtgttctctcttctcccaaaaggatgtgtatataactaaagagaaatgtaaagtgttgtaaataagatggctcatgaaggtacagtgagactgaccctcctgtgtgcagggctaggccatccctctgcatggtgaagagagacactatttttatactgtaatgccatgcggggctgggacctctctgagcagctggggattgttacctagacccaatattttttattattaaatcttgtggcttgacacatctgctgactgaaatggatgtcttagtctaggttactatttttgtcatatggaattgaataaaatgcaggatgtaatgttatttctgagttgcattccttgatttttctaatggagaaagtggaatttgaggaggtcatttgtggtgggtgtgtatccgtggtatttccaccaggaacgtcaacacagcttggcagcttagatttaagcagtgtctcagtgcatcttgattggtcttgaaatttttgttttttgcttttttccaaaataaaaattcagcctcctaaatgt

SEQ ID NO: 47095 - DNA, 526 bp, Homo sapiens
tgagggctcggggtgtctcaagcattaggcagagaaaactgaggtggcttaaggtcactgtgtttcagcagttgaatgttttcattatttatctgtgtcctttttggtgtgtgtgtgtgtgtggtttttttgtttgtttgtttttggttagtatttggtaccatatagtgttctctcttctcccaaaaggatgtgtatataactaaagagaaatgtaaagtgttgtaaataagatggctcatgaaggtacagtgagactgaccctcctgtgtgcagggctaggccatccctctgcatggtgaagagagacactatttttatactgtaatgccatgcggggctgggacctctctgagcagctggggattgttacctagacccaatattttttattattaaatcttgtggcttgacacatctgctgactgaaatggatgtcttagtctaggttactatttttgtcatatggaattgaataaaatgcaggatgtaatgtttgaagagaaaaactattgacgaaaaaaaa

SEQ ID NO: 47096 - DNA, 287 bp, Homo sapiens
cctaccctgacacgacaaacaggttgtggaggagtagccttttggggatgtcaggtggaggaagcagagctgcccacaggcagttccaggaactctcaggtgtgtctgaactggcccaaccgcacactggacgtggcgaacttcatcacattcaagcgatctggattttagtcctgttaaatgctcaggtgtttttgtggtgataacctggaaggaagctgccagggggagtgggagtggttagagaacgtgggatgaggcctaatgataattgcaatcacctgaca

SEQ ID NO: 47097 - DNA, 475 bp, Homo sapiens
gtcattactgtagagtgaaagttcagatagcttcaagacagattgttacctttgctattaatatatatccctatatttatcaccacaggaaataatattttggtaaattttctattataaggtgaagctatttcacatgcgtttttttatagaaattatgaactttgtgaaaatatccatgcaagaattgtccctaagggaaaatataaactaacgaatgctcttacaatcatgaagtcagtacagcttgtggttcatgagtggcagcaaagttgtaaaatggagagagagagagagagagagatttaatattttaaacaaataccctttgtgttgaaattagaaatgtataaatattgatatcctgaattttaattctaaagaaaaaagcagaacgccagtgtcttgataaaacatttctcaggtctaggaaattagacatcaattatattattggagggtttcattgaataag

SEQ ID NO: 47098 - DNA, 415 bp, Homo sapiens
gaaaaggctaaattcttattcttggtgccgtacaaacccacccaaacctatccccacccacccatccaaggaaagttctgaatatatatatattttttcatacagggtcagttgtttatttgctgtgatttgggggcctctgagaagcttttggctgcagaaagggcagcagacttgaagtgtacccctaggcttcagtaggagtttgcctggatcaatgggctttaacctggctgtactttagaatcacctggggaactttacaataccctggcccgtaacaaaaactcccagcctcgtatggtggctaatgcctttgggaggctgaggcactttgggaggctgaggcgagagagttgcttgagcccgagtttgagaccagcttgggcaatgtagtgagacccccatctctata

SEQ ID NO: 47099 - DNA, 461 bp, Homo sapiens
ccacaatagctgcctttgacccagaatttttctctagtcattatcttccaaagaatttttctgcagttcgttatcctctaagttctgaatcttatccaaaacctgttacaacttaaacttctggctcccactcttaaggacttgctgtttcatcagatcttccttctccatttttccatcagtgaaacctaaaataaattcaaaatcataagaatgtaagagcaaacctaatgttctgtatcatggcataattttacttagagaaaccaaaatatctgaaggtgagttgttcaaatcttaagtgacaacagttaacttactatgagcaatagaaaaaaaatttaaatattagaacaagtgctacaaaagaatggacattttgggacagaaactttctgtattggtaaatctgccacccttctgaataataaatgatttgattttacttccacaagaatcac

SEQ ID NO: 47100 - DNA, 644 bp, Homo sapiens
aaaataaaatgaatacaaaaaggaaaaaaattacttctaacatgcatggacacagctctcatttttctctatcttacagtgatgcaaatggtagtaaaagatcccgaagtatgctaggatttcttcttttcaataattacacccatcccttccgtagatatttttcaaatatataaacgaatttgattctgtacaacaatcctgtgcaggaagtactgataagccagtattactatccccatttcagacttgagaaagtaaggctcagaatgggtaatctgagttgactaagtttactggcataataaatggaaaacccaagtctacattatctgaatcttgatccaacacacattcccaaattgcctttggtgaaacatatatacatgccacgagacaggcctctcaggcagctgtaatcatgggtaacctgctttaagaaaatcttagctacaaacatttagatgaaataatgggtaaataataaaggaaggtgatgaattattttgtactttaaaagagagttgttttttgttttttgttttttttttctttgagacggagtttcactcttgttgcccaggctggagagcaatggcacggtctaggctcaccgcaaactccgcctcccaggttcaagcaat

SEQ ID NO: 47101 - DNA, 330 bp, Homo sapiens
gacaaccattttggcataaagtctaacaagttcctgtccctagtaccaaacagaccaagagttgagaattacatttgtcctcttaactgtataaacagccactccctgtttaggaagacaggttctgtaatagcctcttccataagggactatagctagaacaaggaaagatgaggcctattgttctccactcagggataactcttgcaagcttggtagaggggaaagccatcctaaaaatccaagtccagacaaagttaagtgttatgctttttgaagatctaacttcaattttgagtacaattcaacttggatcccacagatagactt

SEQ ID NO: 47102 - DNA, 876 bp, Homo sapiens
cggacgcgtgggtcgacccacgcgtccgctgtcacagaaggttgtaatgagaatttacataatttatccctgtctgcaactctctcttcactttgaatttgaaacagtagtaaccatgattctctttgttacttgcatataatttctactgttaagaaaataacattcaaacctagaagctatggtcttctgcttgttgacctacctctcaagaggcattgattaaagtcaggaagctgatataataagccgagtaataacatgattactttgcagtgttattcacagtgagtttgcagcttaagatgcagccatccattcagggtgatcaggttccctaggcctatttctggtccttttaaggaagttctttggttggcatattctttagggaaataaaaactgtacaaaggctaaatgtgaaaaagtacctgtactataaataattctaagaccttgaattggttggtgacgtcagttcattactattacaggtaaatgtctctggaaaagtgacatgataactgctccttgagacacaaagctgcagggcacatttatataattaattacaccacagaaacacgcacataaacctagagtaatttggtcaaatacacattaagatcacctttatttgcattctcaggataaatctgtctcttgacacgtttcatcttgggtacaggtaagagtacgtcagcaggttttattctggtctttgaagaacaaaggcatgagtgtctggctaaatgaatgagcctataaatctgtgttttataacatattgtacttccagtctgaacaaaacagtgcttattaaatgagcaatgtacaaatggttcagttaatttgttaaaggagtaaggaatcact

SEQ ID NO: 47103 - DNA, 361 bp, Homo sapiens
actaagaaagagggagaaggtgtcccaatccttatctccttcctctagtgctttgtgtaggaatccaattaaaactatatttactataatcacctttgttcttaccaacaagtaagtagcttttagtttattttttaaatttttgtttatttattttttaagagacggggtctcgctatgcccaggctggtcttgaactcatgggctcaagcgatctttctgccttggcctcccaaagtactgggattacaggcatgagccactgtgcccaactaaatagccttttgtttaaatttactcttttctttgaagttaatctagttctggcagctgatctagtgtctttgttgtttcttccagt

SEQ ID NO: 47104 - DNA, 369 bp, Homo sapiens
acttcaggacatttcaaactggactagtctcatatcaattgctcagtagccacatgaggctagtgtctactctgttgaatagtatacctctatacacatgtgtttatatgtttatcttccccattttactatcgtctcctcaaggagagaaatagttcatttgtgtttttatccaagttttattcaaactctcagtgttcagtattgtgatatgtttgggaaaagttaaaagctaaaatgtctttgggtgacatcaatggaagaataatttgcagaagagggagatgatgatactgttctgtttactagacataccgtccccttattattatgcttggtcctaggatccatgctttagaaaggcattgt

SEQ ID NO: 47105 - DNA, 315 bp, Homo sapiens
agaggttgcagtgagccgagattgcaccactgcactctgcctgggcaacaagagtaaaactccatttcaataaataaataaattaattaattaattaattaacaaaagcaaactaaaaagacacttctcagagctactttgcttatgtcgctagttcatggtagaaggaaaatggtgactgtagaaatggtcaaactgggatctttttcaggaaatgaaacacgtaatgtagacttctgtggaaagcatccatagacttatgtggaaagcatccatagacttccgtagaaagcatctgtagacttccgcagaaag

SEQ ID NO: 47106 - DNA, 350 bp, Homo sapiens
tagaaacgattcctagaggaggattgctgggtgcactttgaacatttttataaattttgacaaataatgctccagaactcttgaaccagtctacactcccatcagcagtgatacatgcaccctcccatcccaccttagtgccagtgttactgactctccactagaagctgccctctgcctggactggttggcacttgagttaacatttttgttcaaccgtgatttgctttcctaagacacaataaactcaacaaaacctggttttcaatcttagataatttgccgcagtagcattattccctggagaacagtatcagaccagactttcctgggacttaccaaagcataca

SEQ ID NO: 47107 - DNA, 464 bp, Homo sapiens
tctcaataaacatccccttggtgttacacttaatggggctttgcttttccaaactgctccctttcctgggctctgagcagctgagccgagagctcgtaagctctgctgccccagaacattgtgcattctttgattttgaaaagtctttcctgaaggcctcctcttgggtcattggatcagcccaagagcaaaggatttaaaagggccaatttgatagggacagctcatagccctgtgtaagaccactgggcatttttcctgtttggggaaatggttactggattagcattttgctgtacagggcggtctgcaagaatgtgtgctcttgcctgtcctcaaagcaggcttgtgaggagcttgtctgttcccagccctgccatttcctcccaattggctgggccagatgctccagacacagttaatgagatgctgagggatttggccgggtaaaggcttctgagttg

SEQ ID NO: 47108 - DNA, 263 bp, Homo sapiens
cttcctcattcattggtgaggaatgcaaagttttaggtccttttagcaggaaagggttcttcaaagatattattcccttcttttggtgacacatgatatttgacagtattcatgaataaactataacaatgtagcgccgggcacggtgactcatgcctgtaatcccagcatgttgggattacaggtgtgagccaccatgcccatcttatgtatatgtatattatttctaatgctaaccactgcaagttgcttattgttatttc

SEQ ID NO: 47109 - DNA, 766 bp, Homo sapiens
agggggaaaaatggtaacttcatagggaagaaacttggcaaataccactttaaccaagtgaacagtgttagtattaccagtaagaacatatatcagcatatttacccccaataggatgcacagagatgggtacaatatagcttacatggttgtcttgaccccaaaaaagcgtaacctaaatttaatcatgagaaaatgtcaggcaaacccaaactatgggacatttcacaactaactcactggtactctttagaagtgacaagatcaagaaacacaagaaagactgaagaactgtcacaaattggaagtatccacagagatctgaaaaccaaatgcagtgatcttagacaaagtctctagataatagtgttacaggaaaggggtacctgatccagaccccatgagagggttcttggatcttgtgcaagaaagaattcagggcgagtctgcagtgcaaagttaaagcaagtttactaacaaagtaaagtggtgaaagtacagctactacataaacagagtaggacatttccaaaaataggaggaacgcgtccaccctaggtatatactcgtatatatggggaggtgtgttctgctacaagggtttgtgttaaagggttaattgtcttaattactatattttgcaaaattgatatattatctttaaagcaaaattaggaatgactttgttctccagatatcaggatatctggacactcccaagtctgagtttgtttagtaaacattgttaatttgttcccttaaatgt

SEQ ID NO: 47110 - DNA, 199 bp, Homo sapiens
caggtgggtgtacatttcacaagcacaggtgggtgtgcggaagggtgaacacaggcctccatgcctcagcctacaagatgggtggatggcatagtaaggcaacaattcattacacaatgaatagtaatttgctgttttaaaataactaataaatgtacattgttttacatttggtgaattgattcacctgaagcactat

SEQ ID NO: 47111 - DNA, 504 bp, Homo sapiens
acatcctcttgtcttcagttaaacctgtttttctgaaataccaaaatcttgagaagaatttgagagcctgtgacagtgttaaataaacttggcagtttctacttcatgaattatcaaaactactttggtgggcaatgaacagggaacagagactagacagtttggatttggagtaagtggaggaagcaaagatagggtgtgaccacatgggacagagcacattttcctagagaccaaaaactctgattgtaccctggtccacagactcagtgcagaagcaggtatattaaaacccaagccttataatagatactgggaatgccaaaagcgaggagagtgggggcgggggcaagggttgaaaaattacctataggttcaatgttcactagctggggaatggatacactagaagcccagtccccgccagtatgccatatacccatgtaaaaacatgcacatgtactgcctgagtctaaaattaaaacaacaacaacacagaaccta

SEQ ID NO: 47112 - DNA, 739 bp, Homo sapiens
cttcgaattatcgcattagaatgacttacctacaatagaatacatcctatgactcgatattctaagatgattcatcattagaatgatttgtgccatgcatattgatgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacctcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacacca

SEQ ID NO: 47113 - DNA, 1580 bp, Homo sapiens
ggcacttcgtacaaactccgaaaaatattatatgtgatttagtcacttgttagtagccctatttgcatacttatttgttagaaataatgaaaaaggaaagactgtttactttgtttaaaccttcatttaaaatattataattttgaattaaaactttttgcaatgttttggaaattttatgctgtaacaatctaaacataatgtgaaaaacaggaagatttcatattaaagtttctccattttcctaaacctaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacacta

SEQ ID NO: 47114 - DNA, 1682 bp, Homo sapiens
cgggatgcaaagaaactatccacaattcatggtaaacttcaagaagcattcagcaaaattgttcatcaggtgatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacctcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacacca

SEQ ID NO: 47115 - DNA, 775 bp, Homo sapiens
  misc_feature (42)..(42): n is a, c, g, or t
  misc_feature (45)..(45): n is a, c, g, or t
ggtttgaggcgtgccgccccacggggagaagggatgtccagnagnagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacctcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacacca

SEQ ID NO: 47116 - DNA, 481 bp, Homo sapiens
cggctcaccgatttcaaccaaacaaaaaagacctgaggggtacatctcatcgatttaccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacacta

SEQ ID NO: 47117 - DNA, 1397 bp, Homo sapiens
cgggatgcaaagaaactatccacaattcatggtaaacttcaagaagcattcagcaaaattgttcatcaggtgatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacacta

SEQ ID NO: 47118 - DNA, 1219 bp, Homo sapiens
ataaaatgtttctttttctttattgtagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacacta

SEQ ID NO: 47119 - DNA, 1433 bp, Homo sapiens
cgggatgcaaagaaactatccacaattcatggtaaacttcaagaagcattcagcaaaattgttcatcaggtgatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatccctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacacta

SEQ ID NO: 47120 - DNA, 551 bp, Homo sapiens
aaaaaacaaatttcctaggaaacagcatagaagaaaagttcctatcctgataaagggtcaccatcagggacaaagaaaatatatttttcttagtcaccatcaggaacaaagagaatatatttttcttaatgataaatttttggaaatatttctactaaagtcaggagtaagaatgtccactctctcagggtctattttgcattgttactagagatgctaaccattttaataactccctaatgggaaagaagcaagtattataaaaactggaaggccgggtgcggtggctcacgtctgtaatcccagcactttgggaggccgaggcggacggatcacgaggtcaggagatcgagaccatcctggctaacacggtgaaaccccgtctctactaaaaatacaaaaaattagccgggcatggtggtgggcgcctgtagtcccagctactcgggaggctgaggcaggagaatggcatgaacccggggggcggagcttgcagtgagctgggatcgcgccactgaactccagcctggacgacagagtgagactccatc

SEQ ID NO: 47121 - DNA, 320 bp, Homo sapiens
cagctgcttgcctgccatctctcctattaaaaaaaataaaacacaaaatacatacaagtcaatggttctaatgcagttgaacccctaccatgtattatatacaaatattaactcaaaatggatcaatgacctaaatagaaatgtgaaaactataaaacgcttaaaagaacatataggggtaaatcttcatgaccttagatgtggcaatagattcatagatttaacactaaaagcatgagtaagaacaacaaaaatagacaaattggacttcattaaaaataaaaacttttctgcacaacagacgttatccagaaagtgaa

SEQ ID NO: 47122 - DNA, 806 bp, Homo sapiens
cattactttcttgattctcacagcaattctgaggtgtatgcgttgcaatttctgtttcacagatgaagagagtattgttaataagttaatggccgggcatggtggctcacacctataattccagcactttgggagaccaaggtgggcggatcacttgaggccaggaatttgagaccagcctggtcaatgtggtgacacccatctctactaaaaatacaaaaattagccaggcgtggtagcacttgcctgtaatcccagctatttgggagggtgaggcaggagaatttgcttgaacctggcaggtggaagttgcagtgagccaagattgcaccactgtactcctgcctgggtgacagagcgagactctgtctcaaaaaataaaaagttgctaagaggagggctgggatcttttggctccaaatctactgtgggatgatgcctttgacattcctgatagctgtgcagtaatccattaacacagtttttataagttcaaaccctgttgccaacatttagattgttccatgtgtgctgttacaaataaattactataaagattctatacatttaatcttttattatttttgtattatttctgtaggccaaaatctgaggaacaggattactaggttgaagggaaatggcccttgaagtgtctgatcagatgtctttccagaggatccaaccaatttaaatagccaccatcaatgcatgagactttgtagttcagggaaggcaggcctggttttaaaaatcatttcccctctctagcatttttctgatgtgatccttaagatttcacttta

SEQ ID NO: 47123 - DNA, 492 bp, Homo sapiens
aaaaaaaaggtagtctgtagggattccaggaaacttacattctctgagggagcttacagtgccttttgaagtcaccagtagaagtaaatggggtcctagcagttttggtcattaagtatttaatgcacagagcatatttggatttttttcattttctgttgggagatacattctacctaaatcagaggcagaagtttagggttgagttttccttttcctttatatttcaaagtttctttgtaaaactaatttataaaatgaccaatttcaagaattttaaagtctttcacaagaaatggcaaagataggattgtgatagggtcctttatccagtcccagggctgatttctggagttttctgcaagcctgcatgaaagagaatggggatatttcaagtgcaaagcgcccagaggaatggctgctggtgcggctaatggtctctctcttcctcccctggcaataaatctcagatattgaaatatagctttggag

SEQ ID NO: 47124 - DNA, 309 bp, Homo sapiens
agaaagtccaacatatattcaaaataggtaccaagaaagcataacattgtaagaattcactgcagtggatcatctgaagggtctaaggtgagaaatgaatatgtagtgtagaagttgaagaggcatccacaggaatgatctctaatgaactggatctgcctccaagatagagatcaaaattggtttaaaacaaatacaagccaggtgcagtggatcacgcctgtaattccagcactttgggaggccaaggcaggagaatcacttgaggcgaggagttggagcctagcctgggcaatatagtacgaccct

SEQ ID NO: 47125 - DNA, 392 bp, Homo sapiens
ctttgttccctggaccaagttccactgcgttgactcctgcctgtgcgcttctgtgttcctgctgacaccccctgtcactctccctgccacctgcattacggaggacccagtgctcacctgcctctcacccaggatctcaagcacttgagagcagaggctggcctcctgcagccttgtccaagaccctcccacccaagacacagacgatgctctcaccaggtccccgctgggcttgactgctttattttactcttggaaacagcttcttaatgtgttggacataagtagccaagacaccaagggaggtcatggtctcttggcagaaaggcttccttgtgccatggctctcttaggcatagaaagctgtctcatcaaactcagtggcaaatctt

SEQ ID NO: 47126 - DNA, 820 bp, Homo sapiens
acttcatgtcaactaattacatctacaacaatcctgtctccaaataaagtcacattctaaggtgctggaggttaggacttcagtgcctgaactttggcgcgatataattcaatccataatagtaatgataaggtcaaggatatgaccgtgggaatagaggtgggttgatgtcaagataaaagtcgatcgggtgagaggccattgtattggaaggatcaatgacatgtctattgagccaccaataattatgacagaaatggtatctgaggacacaagtgtcctcttcccttcagcttcctacattttaatacaaaatgtatttaatacaaaatatattaaaatgtctaaaaactgtataaaatatataaaaagtaagtattcagcaaattttcaaagtatgaaatatcttaagactaagatttaaaatactatggtagttatctcatatgtaatgacttcaaaaaagttttcattaaggatatgtttattaataactgcttatactattggttttatataatgcttggcctcggcagaggagatgggaatatcagggatgagcctaccgggctcccaagctccatctgccctggagtactctatggcaggcccagtgccctggctctgggtgcaagagtaggagctgcccactgctggaacagcgctatgtcataccccttagacccactaaaggggcctttggcaggtccaccaagtagactatttcttattccctaactctgtcccccaggctttctccctcaattgcctcccacatgactccagcagttcccttaacttcacctgcccaatgttccca

SEQ ID NO: 47127 - DNA, 337 bp, Homo sapiens
aggcagggcccctctgtcggtcttacctgagatgacacttagggcctcggcagaggagatgggaatatcagggatgagcctaccgggctcccaagctccatctgccctggagtactctatggcaggcccagtgccctggctctgggtgcaagagtaggagctgcccactgctggaacagcgctatgtcataccccttagacccactaaaggggcctttggcaggtccaccaagtagactatttcttattccctaactctgtcccccaggctttctccctcaattgcctcccacatgactccagcagttcccttaacttcacctgcccaatgttccca

SEQ ID NO: 47128 - DNA, 3772 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaa

SEQ ID NO: 47129 - DNA, 361 bp, Homo sapiens
cttaggccacatgtgcttggaagcatcaagtctgaaccctgcaacaccaatgtcaatgagatgattcatatattcggcaatcttggaacgcacataatctttctccagtgcaagatcaagaagaccaaccagacgacaatctctgacctgttgaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47130 - DNA, 242 bp, Homo sapiens
  misc_feature (30)..(30): n is a, c, g, or t
ggaaacaaaaaaaaaaagcaaggcaaaganttcaaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47131 - DNA, 5554 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47132 - DNA, 5281 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtctcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47133 - DNA, 5496 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaagtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47134 - DNA, 5311 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47135 - DNA, 5418 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47136 - DNA, 4045 bp, Homo sapiens
tacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47137 - DNA, 1269 bp, Homo sapiens
tttggaaagaaaacaatttattatatctgaggaaagtcattacaatacatgtaatatatttccaatttactgatttaaaggcgtatggatttaatttttaaatacactttcaaagctgttatgcacagttccatagtccaggtggtcaatttcttcttctcaaagttgcaccagcacttgaaggacatgggaatccaaagaaacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 47138 - DNA, 5718 bp, Homo sapiens
  misc_feature (5616)..(5616): n is a, c, g, or t
  misc_feature (5622)..(5622): n is a, c, g, or t
  misc_feature (5625)..(5625): n is a, c, g, or t
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaataaaaaaaaaaaaaaaaaaaaaaaaactgttgggggcgcgcgccttgggccccaggaaaagatnttaaanccncctccgtgtggggcggcgcgggcccattgtaggggacaccggcccacaggggcccggaaaccccggccgaagggtgggtttcccccaaaaaac

SEQ ID NO: 47139 - DNA, 5054 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaaggtaatgtcacgaaataaactaagcacatattccattttacatatctttgactctatagaaacaaaacaaatctgtcatgccatttaccttaatttaaggcacatactttaaaacatctctccaattaatgtttgtaatcacttcttctgttttttttaaatactcatactttatagtggagggaacgttcctttccatacagtgtttccagtctatatttaggaaaaaattttgttttcattcctaaaactttcatgtggcatttaaaataagtcagtgtgtcccacaagtctggagttatattttccaaatgcagctgatagactgtcacaaatactgtgtctgagatacatacaaagcgatttaaaaaaaaatggtgattagaaatacatgattttaggattttatatcctaacatgataattttctacttctcaaagacttttactgttttggtacattgtcagaaaatatttagaggctttagattgatgtgtagcacataatttttcctacggtaatgggaaatagacttctagctaggatttttacacaaaacatctatctgattttctagaacagattactgacattaaatgagaggagctatacaagggttcttaggccatggtttgtctgagatgcctgatactgtgtttacttcattcttgcatttaaatatggaggtggctgatggtttgggaaattcactttaagcaaaataagtacccaaatcaattaacatatatactttgctcttttttataacatgactcatcttaacggacctttaatagtagatattttattggacaaattgtagttactctagaagtctgaaatttttaaaacaaaagttatatatatataaagttttttatataatcaattcagattttcagtgagtatatttaaacccatttgtaatattgttactaattttgttactaattttatgtaatattgttactaattagttcatatgaaaatgaactaattttcattttatgttaaagtgaaaattttaacattttcataaagcttattttgtctatttaacaattaggtttcaaaattgtaattatctttaaaaacttgcttaaaatattttaattttatatctttgttttttgttttttaataagaaatggaaacactttcagttttcagaagttatgaaccgggtgaaccaaactgtagaatttatgtaaagaatttagctaaacatgttcaagaaaaggtaggtataaattgattttttttcatgtaaatgaaaataatttgaaggttttatagttgatgtgttaaagtctgtttgaaactacctttaagaatgtggttttcttactgtgcttcagggcatgacaaattattgtttagtattttcaggttaattttttattaaaataatactctcatagcttgggttctctggcagtaaatactgagacagagtttgtggtatgtattaatttcctagggctaagtggctgaaacaacagagatgtgttgtctcacagttctggaggcaaactgaagtcaaaagtgtggcaggattggttcattctgagggctttgagtgaaggatctgttctgtgcctctcccatagcttctgctggtatgcagaagctggcgaactttcaccttccttggcttgtggaagcatcaccacaatttctgcctttgtacatagcatactccctttgtgagtatctgtccaaatttccccttttgaaaggccaccagtcatattagattaaagcctaccttagtccagtatgacctcttctactgatgcattgatgtatttatttatttattaagtttttttcccctggctttgttatttgtctttttcttattgaaattctaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtatgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttg

SEQ ID NO: 47140 - DNA, 5817 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaatacaggaacatggttaatttccgcaatgtagtggatggccagccttttacaaactggtatgataatgggagcaaccaagtggcttttgggagaggaaacagaggattcattgttttcaacaatgatgactgatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47141 - DNA, 5291 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47142 - DNA, 5423 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaa

SEQ ID NO: 47143 - DNA, 4101 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaaaaaaaacacacgaacacattcgcaccacacgcacgaacaacaaaaaatcggtgcgcggggcgggccgaaaagttcaagaaccctctgggggggcggccccagaaggaaaagggcaacgggccaaggaacgcggcgaaggggggtccccaaaaaaccggggcggcctaccccggggggccggtaacaggcgcga

SEQ ID NO: 47144 - DNA, 4227 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtggataccaaccagttagctataaattatgcacaagatctggaaatgaagatgaatttagaaacatggtgacta

SEQ ID NO: 47145 - DNA, 2694 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggtaggtataaattgattttttttcatgtaaatgaaaataatttgaaggttttatagttgatgtgttaaagtctgtttgaaactacctttaagaatgtggttttcttactgtgcttcagggcatgacaaattattgtttagtattttcaggttaattttttattaaaataatactctcatagcttgggttctctggcagtaaatactgagacagagtttgtggtatgtattaatttcctagggctaagtggctgaaacaacagagatgtgttgtctcacagttctggaggcaaactgaagtcaaaagtgtggcaggattggttcattctgagggctttgagtgaaggatctgttctgtgcctctcccatagcttctgctggtatgcagaagctggcgaactttcaccttccttggcttgtggaagcatcaccacaatttctgcctttgtacatagcatactccctttgtgagtatctgtccaaatttccccttttgaaaggccaccagtcatattagattaaagcctaccttagtccagtatgacctcttctactgatgcattgatgtatttatttatttattaagtttttttcccctggctttgttatttgtctttttcttattgaaattctaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttca

SEQ ID NO: 47146 - DNA, 1525 bp, Homo sapiens
ggtacaattgtgaaatgtttactcttgttcttttaactgaaggcattgacaagactccatcaactgaaacttttaggtcatactttagtcgttgaatttgcaaaagagcaagatcgagttcactccccatgtcccacttcaggttcattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaatacaggaacatggttaatttccgcaatgtagtggatggccagccttttacaaactggtatgataatgggagcaaccaagtggcttttgggagaggaaacagaggattcattgttttcaacaatgatgactgatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47147 - DNA, 758 bp, Homo sapiens
tgtattggtggtgctctctgtattggtgggctttggtaatgataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaatacaggaacatggttaatttccgcaatgtagtggatggccagccttttacaaactggtatgataatgggagcaaccaagtggcttttgggagaggaaacagaggattcattgttttcaacaatgatgactgatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47148 - DNA, 1335 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaa

SEQ ID NO: 47149 - DNA, 721 bp, Homo sapiens
tgcttaggaaacagaagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtgttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtggataccaaccagttagctataaattatgcacaagatctggaaatgaagatgaatttagaaacatggtgacta

SEQ ID NO: 47150 - DNA, 609 bp, Homo sapiens
tttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgcctaggaacgctaaacataccctaggagttttcatctaagtacg

SEQ ID NO: 47151 - DNA, 2148 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaa

SEQ ID NO: 47152 - DNA, 5530 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaata

SEQ ID NO: 47153 - DNA, 3696 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaactgggttatttaacagtagaaaagggaatggcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgaccgatatcgtgggtaccagctcgattcgtatcatgtctaa

SEQ ID NO: 47154 - DNA, 2099 bp, Homo sapiens
atgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttcattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaatacaggaacatggttaatttccgcaatgtagtggatggccagccttttacaaactggtatgataatgggagcaaccaagtggcttttgggagaggaaacagaggattcattgttttcaacaatgatgactgatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatgga

SEQ ID NO: 47155 - DNA, 460 bp, Homo sapiens
agacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaatta

SEQ ID NO: 47156 - DNA, 771 bp, Homo sapiens
aggggcacttacattttgtgaagtcgtaggtaccattattaggtaactctgaacgctggagaagtcttatgttcaatcaaaaatccacctcattgcaccttccaatgattggtcccagtcctgccctgtactttctctaagctctaaacttgggagaaggggagaattcctcttttataaagagatgaaaagatgtttgagctggactttgtaaaatgtttagaatttttagggagtggtgtcaccacaccaccagatcctcggaaaaatacattgcatattccttctttatgcagattctagagtaggaagttttcgtctctctcatccaaatatgccaaggaatttagcaaattttcagtctttcagggacatctgccaacaattaccaataaatcaacgttagcataccttatgggaggagagagaaggaactagaagtttcatggttttatttccttctctgatggtgtggtaggaaggaagattaactggtttgatctgaagccttactgggtataaatctcttagatacctggcccagattaactgaattatcccagtattgagcatacaggttgtcaagggtacttgtatcacattgatttgcctaataaccctaatctgactgcaacctcctccaactgtaattaggaggttccattgtccttctcttgcaagttctaacatgttatgttcccatcttcattcgaaacggcctgagttgcatgataatatctcaagctgccaaaggccacagcttctttatta

SEQ ID NO: 47157 - DNA, 2288 bp, Homo sapiens
tagctgatcactgatctcctctgcactctcaatatggacacactgatgactagaccagctcaggcattggaaataattggacccggactcagtttacagagggtgcacgatcattcagaatttaagagacttgttttgcttggagcaaaaagcagtatcctccctttacagatacgtctttggcattcatagtagcgaatttctggggccagagaggtgcacacagcttgccaagtgataatgtggttttggtgacagcctttactgcaacactcactggcctcatttgatgaatcactttttaaaccaagtttcagggtgttgtgcttaatgtatacagcttaagagttaagagaccaagaatatatactgtcttcagctttctcacttgattttgtttttattttgcaaagttggtgtaaggctgccctctaaatataaagtacatctttttttttttttgtaaatagctaaattatatgcaatttcagtgtaatttttctgatagcactaaaatatgttgtggccagctctgaatttctgaaatattgtttttataaaatcagcacacccacgctctttctcctttcctttttactgtatgtcttgtttaccgggtttggggaaggtataggaacttaaagtatttttaactagagaagttaaatgtaaaagtgcatcaaaacaaatgggggtgactgaaattttaagcattgatggaggcatggggaaaacatgactttatctgtctaaaggacattccctgatgaaggactgtttggacagggattgtaaatttcagcaagctttttagaaagatgctttacaatgcaagggtaaagagaggtcattatgtatgaacatgaaaagagaacataatgttgttaaatgaaaaatggagtttacaggataacataggttgattcctttttgtaagtatttttcttacagcttttaaaatattcaagcaaggagttagtgactggtgtctctggctgttttggcggtgggatgtatttatatggactctaacagaatgtcagatgtgtggcaagggctcagaatggtggtggtgcttgttgatagagattttagcagaatcactaacaggctacgaagaagtaaatcttggttgtcttttgttcatggagatgttttttatttgccaatattcgtagtttgattactctgtgattctcctgcattttgcatttacatagagaggataggagtagttctcagggtgtatactgtcttgtttttctgttggaacagagttcttgatttgccttaattagtcctctaacaatctgcaaaggtcagtgccaattgcctgttcatttacatttgtaattgtgatggcttctgattacatattccttgtcttagtccatcctaagtatatgctagtgtgtcctccccactacccgctacacacacacacacacacacacacacacacacacacacacacacacacacacacacacacacaccccagagtggtgtgaaggccaaaaatctgactcctcatagaagaaacctttgtagcgactgcccagcctcactggcacttcagtgtctgttctggaaagccatcttggagacgctattgcttctaagttagggatataatgaagccagagtcagggaaattacgtcgataccaggcaagaaatctgagagccattatctaggagccttgttgaactgagtaattaagggcaattaaacttttctgcttgctctctgcaaaatatgctaatgatctggtctgctggaaggtggacatatgcagtgctgtttcactgctgtcagacgctgctgccctggaaggtccccctggagaaggtgtggcatcaccaggatggtcaggtgggcagtgggttgagcgtgcagcctcgtacccagcctcctgtgtcctggctggctgttccaggacttgcaccttttcagcagttatctagacctggccgcagtggcctgagttgcagtgattcgtattcactcattctttgatgttctagatccaccattcattcgttgcgttatttttctgggatgatgaagctaccagggttttgtgcgtgttgtttcagcatatgacacgtggcaccagctgtacactgcccttctggttagtgttgttcttggtcaagggctccaggctgtcttccatgctatcttcatgagtgggtggcagcacgtgcccaacgctgcccactgggagaagcattgatactgtggccactcactgcagagagggttttttttggcacagcaaaaaa

SEQ ID NO: 47158 - DNA, 420 bp, Homo sapiens
ctcaactgttaccttactaattcagtgtttctataaaaattttagtttatgagatgacattatcaaagtgatctaataaataagtatgccaattagactggtgagctatagattcttcattttcactttaacattaaaaatataattttcagtatggcttggtgctatggactgaatatttgtatcctccccaaattcctatgttgaaatcataccccaaggtgcagttattaggaggtgaggcctttgggaggtgattaggtcttgaaggcagagcagggtaacattagtggccttgtaagagagaccacagagagctagccagcttcttctaccatgtaaggacacagcaacagggcaccttctatgaggaacaggccctcaccagacactgaatctaccagcaccctgatcttggac

SEQ ID NO: 47159 - DNA, 111 bp, Homo sapiens
tccagtaaccaacctcaaagaaatggagatctgcgaattgctagacaaataatttaattgttttaagaaagctcagtgcgtgaacccgggaggcggagcttgcagtgagcc

SEQ ID NO: 47160 - DNA, 859 bp, Homo sapiens
gggagaggataaacatcaaattcagagtgctggttacttctgaggaggcggagagggaagtggatcaggaggatgcatccagggtactgcagtgttttaattctcaagctggatgctggacacacagatgtttattatcttattttctagatatttttatgtgactgaaatatttcgtaaataaacagaacttttgttattgtaggctaattcatctcaattttggcatgtttttctgtgatttcacatccggttatttcccaagccttatttactccttattgcattgcattgtccatccatcatccgccgtttttccatttttacacaagttattcttttgtaatgtcctcctacctggtcttcctccctatgtgcttcccacccttcagtctatatcagtcctccagaatgacagctttgatggtatcagtaactggccagaagtcgtcagtagctctgtttatttacagaatattgttctcttcattagcatggaattcaggagcctctgtggtttggcttccaccctgcatttccatatttcccatgattctcccttgccacagtatgagaacttcccctgctttcccatcttgatatccttgcttatgttcctctttcagggagtgcccttccacccttacctgtttccagtcctgcccaggcatgttcatgagcagagtttgggagaacttttttcaaagttgagtaatatctggatccctaataaaacagttcttatggattcctaatattgatttaaatgtattgcaaaatcacttcaatatacaaaactatgaaaacatataattaagtagaaaaatgtttctcacttctagataaccacaaagccaaa

SEQ ID NO: 47161 - DNA, 448 bp, Homo sapiens
attcggcaccgaagaagatggcacaatagaagatgacttgttcttcatcgtccttgtcagccgacggctgcagcgtttgagaacatcaaaactggagtcaaatgatcagaatcacacactctagtagccagataggaccaagtaagtgacgacccattctgccacggagatatcagggagggtccagaggcaatgagtccatctgaggacccccttttctttcagtcaccatgaggtctcgtaagctgcactcttactgctgactgctattcacttgatacacgtggtctggccatactggtaatttatgacaaaagtctcttctagttaataccagttgttaaatattagcattgtgaatattgttcctccatgtatcccatattccctgaagctctcttagagggaaagcctgaactctcaaacacagagaattttattcaaagag

SEQ ID NO: 47162 - DNA, 317 bp, Homo sapiens
ctaaggtcatggggtgagggactgtgaagcactgataaaattcacagtccagggctcaggctcaccaaaatctgagacctaatcatagaatgagtccttcccgtttcaccttaccaacacatagctaagggcttattaaaaaaaaacaaaacatagtttcttttacccagtgcatcatgttcacctttcaacacaaaattaaaaggcatactgcaaggaaaagaaactacagtttaaagagactgaataagcatcaaaccagagtcagatatggcagaaaggttggaattatcattctaggaatttttcaaactatg

SEQ ID NO: 47163 - DNA, 169 bp, Homo sapiens
agactcctctgagagaatggcatgagagcaggtctcttgtgattgggacgagaatagaagagaggcataatacacggtacattagccttcttttccttaaggaagtgtcatactgagggtcctggcaagcattagaaccggagggatagggtgccaaatggaaatggag

SEQ ID NO: 47164 - DNA, 636 bp, Homo sapiens
caatcccatatttcattaaattctcctgaagtaaataggatttgtaggtagcctcatgagatgattttatcgttaagcttatgtataaatcagtagttggatttccaagtaaaatggagactgttgtaattgtagtaaacatggccctttttcctgtgtgcgtgttgctgttggaattcagagtctctcctcccaccctgggacctcagagatggtctgtccgtgcagcctccacaccccagtgttcgcaacggtagtggcaatatgaatcaatatctccttcggggtggtttgatttaatcagggacgtgaataaattaaactccctgaagacctagtaaaatgccataaaaattacttttggtcataatgatgtgcaattaattgtaaaatacttctttaatttatttagctttatgaggccaaatcaataaatgttttgcaacagacagatgatgtcagaatgtttttcacaaagataactttattaaaaattctatgtacatttattttttcaacattatattttctttccttggataaattgttgtcccttcaccaatgtctttgttgtggtactactatattatgaaagcctttcattttattaaaaacgaaatgaggcagcagattctt

SEQ ID NO: 47165 - DNA, 1080 bp, Homo sapiens
gaaagggctcctcatctcctgattgctaattaactttatctccttgaatcaagggagctaaaggaagtctctgaattagaaacctttgtggtgaggggtaaaggaactttggtaagaggatataatcaaaaatatgatgattaaagaaagatgattaaagcttggaaagcaagtcactaacttattaacagtggctatctttaagggatgggattagtaaagattttcatttccattttatacatttctatattgccaaattttacaacaagcttatagtacttagaaagttggaagaaaaaccggccgtgcacgatggctcacgcctttaatcccagcactctgggaggccgaggtgggcagatcacctgaggtcaggagttcgagaccagcctggccaacatgatgaaactccatctctactaaaaaatacaaaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgcaaaaaaaaaaaaaagaaaaaaaaagaaagaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgac

SEQ ID NO: 47166 - DNA, 412 bp, Homo sapiens
gggattacaggcgtggccccgttgccaggccaaaatatagttatttaatttaacaaatacttccttaagcataatagtccattaaagcaaataataaattaagtactaattattacctacttctccaaacttgtaatcaaataatttctttgtaatcaaacattactgactcttccattttaagtggtcctttatgttctgccatctggatagggcttatctttagttgtccttccaaatgagattattttatgaattgcatctttactttgtccttttgcttctagccaaatcttcagcctggggttttctctaaactgtttctcaaccactgcgtctatgctcagccctaccattacttctgcttccctcactaccatcaataacttggctcccactgaagtatattttg

SEQ ID NO: 47167 - DNA, 317 bp, Homo sapiens
gttcaagtgaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggaggcataacacagtccacaattgcaatctctctctagtcagccattccacagggactcaacaacaaaagccgcacgtggttatggatggcagcaaagga

SEQ ID NO: 47168 - DNA, 482 bp, Homo sapiens
cttgagtttttaccagttgttctttttatattctaggatcccatttgtcataccacattacacttagttgtcataagacaataaaatttctatttagcaaatgtttattgggtacctcctttgtattgggaactgttttaatagtgtaagggatctgtccagtaaacagacccaaaaaatccctgccttcatatgaagcttgcattttgtttcctttaatatgctcaagaaatttctaatgaaaagtgaaacaaataggagatcatatataccaagggtgtgattattggcctgtaattttgcctccttctttgaattttctttttttaaaatctaggctgggcacagtggcctgtgcctgtaatttcagcactttggaaggctgaggtgggaggattgcttgaggccaggagttcaataccagcctgggcaacatagggagaacctgcttgtatttaaaattaaataaatgaaaaaggaaa

SEQ ID NO: 47169 - DNA, 321 bp, Homo sapiens
gaaggcagagttgaaataatttaatattagggactgtgacacagagaggtaagatggcctcatcaaggacacacaacaagatacttgtagagctgagatttgaactttccagcccagtgctcttccaaagacacctacttggaggaggctgttcttcagcctgttctcctattgaagtgtctgtgggaatctcctggtggaagaggtcaaggtgagataatagtgtagtgctggacagccctttcctggcctcccttggcagatctcttccttgtgaaccacttttaccttggaaccacaagcagcaagcagtcctggtgc

SEQ ID NO: 47170 - DNA, 851 bp, Homo sapiens
tgtattcacggctgaacattaattttgaaatagcctttttatatttaaagacattaccaagttacgactttcccaacccatcttagaagttgacctctcaagtgcacctgtgtaagacttcactcgttaacaataagagatgcatggaattgccccgtgtatagccagtgcatggatgtatattttgtagggaccaaatataagctataagagcatataggttccaaaccaagtatggactgggagtggcgagttgcagacacaactctggaatcctgctgttgaggacagaagcaggcacatggggaggagcagtttgaagactagaaaattgagattttgttttgtagtatctttaaactccaggtgaacttggttggtgaatagagcttctgtgagggcaatttactgttttatagaattgatttcctaaaagatttgccattaactgaactgtcttctgctaaccataacttctccttgattattaatggacccctgttactcattaaaacctttaaaattacttgagaatgcctgcttctagtcccagttcattcgcaataggtgctatccaaattggtacccaaatattttctaaacaacatgaagtggaatcacatctgaggggtaggatctgagtgaaaagttggattaatagaattctggaccaaaagcagtacttgtggacttaagcagttttttaactacagcagatataagagaacatggctgggatcaaaaaatgcctttatcttgaatacacactagctgagacagagcaacagtgggtgtggggaaaccttggtttgccttgtagaactacctgctccaccccaccaataaatttc

SEQ ID NO: 47171 - DNA, 663 bp, Homo sapiens
caagcagctgggactacaggcacccgccaccacgcccggctgattttttgtattttagtggagacggggtttcaccatgttagccaggatggtctcgatctcctgaccttgcgtgagccaccgcgcccggctaagatgtaaaagtcttagaacgtcacactacagcgtgtgtttctgtgatgcctgtttccccaggctcgagacctccgtgtgcagtgcttccccgagcacagggaaccagaccagtgggagcaggaaggacctctgcgaggtgttggcaccttagaaatttctctatctatcattttaagaaaatccaccggcctgctgcgtcgccatgcttctgcagctggtccagggacagagcttcgagtgggctggcccagcctcatttcccccatcaaccccattaatttttttgtatgggtttgcagaaacgcggtttttatggaggcatggcacagcactgtaggagaaatggcaacctgtgttgctttgaactctcttaccttgttattcgtaggtgactgttagttacacttgcaaaagccaaatgaaacactgtcatgattttatagttccatctcttgttaaaattggaaaaccactaaactctacctattgaaagtaagtaaaggtaattttttgagttgaaaaagaaag

SEQ ID NO: 47172 - DNA, 412 bp, Homo sapiens
cccagctacatttgatatctttgaggatgaggaaaaagtgtttatgctgtgtaaataaactaaattgagtcctgccttcaagtagtggagataaacatgtactagctataatctgaggcagagttgagaggagttgggaggagcaaataatatccaactgaagccttcaaagtcaccctcttttaagaagtgacacttgacctacgcctcaaggctaactaggattttgattggtggagaagtcctggaaggacattcctggaagagaatgcaccttttacaaaaatatgcaggcatggaagcatgtgacctgggtggcaaatagtcagtggtttgcagctacaacattttaatacgtggaaagaaatttaatgaaatgggtcaagaaagtaaaattgaggaatgctttgtg

SEQ ID NO: 47173 - DNA, 422 bp, Homo sapiens
tgtcctcgccatgctgtcctgggccccgcaggcacggactcaaaagaggctgcagccacagtcaggaaaaaggccgcttggaggaggccctcggagagccccaggcgctgagccgggaaatgggcagctttgccttcaggttggcttctcctccctccccgtcccccgtgcctgcctctcttccacagacccactcggcatcccacgccggggcacacgcaggctggccgcggggcctgtcacagcagcaggggctctggtttaccccagtgctcataattgcccaatttcagaaacaccctactctgaggaaggaccttgccggggggattttgagaagggtgtgtggtgatgtggaggggctcctgtgcggccagctgtccctgtggtggtccctggcccggattccctttgggctgcag

SEQ ID NO: 47174 - DNA, 395 bp, Homo sapiens
gatgttttgtttcttcttttcaattaaaagtaagactttagttttcaaccagattttgtcaacagagatgtttattttcacaaatgcttcacttactcaaactttaacaatctctcaatcaactagaaaagtaatatcctgttgttagttactcttttagtagttacaagaaatactttatagtttttagattgatagcagaatacccagtggatactgacacaaaaattattttttgttttctctactatccataccataagagaaagaagaaaaaagaatttacattccttagcttacataattgccttatattgctatgattattcattggaaactaagatgagtggatataacttggaacaatatagttaatctctggagaagttgctacc

SEQ ID NO: 47175 - DNA, 399 bp, Homo sapiens
gctgcagagctgctaagtgtcaggttggaaagcagccctggctgttctaaagcccaagttctctcatgaccccactactctgtgcccgctcgccttcagaggtagaactctccaagcatctcggaaggctcggttctaaaagctgagaggctatctaggccgcatgcggtggctcaggcctgtaatctcagccctttgggaggctgaggcaggtgaattgcttgagcccaggagtttgagaccatcctgggcaacatagcgagacaccttctctacaaaaaagagccgggcatggtggtgcgcctgtagtcccagctactcgtgggggtcgaggctgcagtgagctgtgattgcgccactgctctccagcctggtgacagagtgagaccctgtctcaaa

SEQ ID NO: 47176 - DNA, 309 bp, Homo sapiens
ctctcatttcacctctttgtgttatgtcacatggtgttacttaagccaagctgaaattcagcagtggaaagagagcgcagaggagcatttttctgggctgagttatgtttagcgtggaatcgctcttaggcaaatgtgcagcctgatgaatggaaattggaagccatgaatagattctccaggaactttcatacccaagaggactccaggcaggctggatttttggtttctaggcctgggcgactcactgccgcagcctgcttcctggatggaactctgggtcttgctgctgcaaaactgggtcagggg

SEQ ID NO: 47177 - DNA, 595 bp, Homo sapiens
ggagttatttgtatcctgctgctcaaggtcatcgccaaggtccgatttttcacaaaaaaaccttataacctccagcataaatgggttaatttaatcatttcttattgatttcgtctgtcctaatagttcttaatctactttgggtcttggacctctaaaaatctgatgaaaacagtgctcagaaattgtaatatctacagaaagtttatataccaatccaggttgtttacaaaccctttgaatcctatctatgacacccaggttaagaactcttgtgctttatctccatgctggtctcaagtaacatcctacagtaattcaccaccactataaaattttatcactaattagaaaaagggtggaaaagatggaatgctttaaaaattttaagaaccatagatttgttagaatcattaaaaatgtgttggaaataaaagcaaaaggaacatccttcagtctactttcaaaattttaagtatgttttacaggccaagcattgtggctgtcctgtaatcccagcactttgggaggccgagctgggcggatcgcttgaggccaggagtttgagaccagcctgggcaacatggcaaaaccc

SEQ ID NO: 47178 - DNA, 1045 bp, Homo sapiens
gttcccctgaaggcagtaggaagtttaggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttggtgattggaaaagtctagaaccccaccactaaatccattcatttatatatgcatgcatttactcatgcattcagtgaatatttattgagtacctactatgtgctagatactaaactggaggctgcacttgttcattctatataataaagtctagcacccacttgaacttgctacgg

SEQ ID NO: 47179 - DNA, 738 bp, Homo sapiens
tacattgaaaagtattttttgttatatttacctaatatttgtaggcatttgtaaagtgatggatttaaaggttatattcattatctgctggaagtctaaggtataacgaagtgatgaatgtgtgatagccattgaataaatataggaccaacttaggctacaattgaccaacttatttttctgcttaggaataccttagataatttcagataatggagttctagtgtagatcactgaagaaattgtaggaagataaaattagtcatttttcttctttcccaaatgcttacatgtatttatacatacaggcagatgagcaattgttatcttagaaagcaaccttgtattaccaaaacaaaatatagatttattcatgggggattttatgtgtggaggtggtgttttaaaattttagtaattaagtgaattttcctgccgggtgcggttgctcatgcctatagtcccgacactttgggaggctcaggtgggaggactgcttgaggccaggagttcaagaccacccagggcaacatagtgagatcctatatctacaaaaaaacaaaaaaatcaggtctacgtggtagtgtgtgcctgtagtcctacccactggagatggtgaggtggcaggatcacgtgagcccaggagtttgagactgtagcgaactatgattatgccactgtactctatcctggggcgacagaatgagactatctctcttttttttttttttttgagac

SEQ ID NO: 47180 - DNA, 265 bp, Homo sapiens
tcatattgtgtgttggaatgtaaattctaatgacctttggaagcattagtagtaaaatttacttagctggctattcctaagcttactagtgagttggagttgcatgcgtgaatcatacctctgaccagttgtgatgatacaaattaagttgagtttaaggaagagactaaattaattgccatcctgtcaccacactgtccacttagcactgtacagctaagatcctttcagttttttaaaaaatacttttttaataccacagata

SEQ ID NO: 47181 - DNA, 508 bp, Homo sapiens
accagcgtataaaaatcttttggtgggtaggggttggggataaaaaatgttgccatgagctacttgtaagcatcagtagatggcccagcatggccatcctctcagtccacccaggatcggtgatggaaatcacactctgcctcctttgggccctacttagcaagatgctttaaaccaagagtgcacattaacagtgacttcctgtgcaagtctttaaagagctgtcccagttaaagcctgtccaaaatctccacagtacaaaaaaatggtgagtaaaacatttcttcccatactgtttccttgactggagaagttgtcccagatctgttcatgtcatgacacactaagccatcagccacacattcttgactatacatatttatcaagacaccaagaagaaaaaatccaccaaacaaatattagcaatattttatatcaccaatctttttactagggttatttacataaccaaaaattaatcacttcctgtccttcctctgttcatggt

SEQ ID NO: 47182 - DNA, 211 bp, Homo sapiens
aggaccattttcatgtcttaactaagagatgaaggagaggtagaaatatatctctgttgacatgatagcagataaaacaaaaatatgtggagctatcccatgatgaatattcagctgaggggaacgtgctcgtgccagcctgcatctccactcccaatcctcactgcaccgagactcacgaggaatttattgctcattttaatcacaccca

SEQ ID NO: 47183 - DNA, 739 bp, Homo sapiens
gaaacacttgcagggccacaccttaggaataaggaccacatcttagaatttaggtctataccctaggaataaggacaaaactgaaagagatccactccaataaaggctaaaactaagcttccacaggactaagattgtctgtcaacgatttagccatctgctagggcaaaactcaatgcctttcaaagaaagatagtaaactccagagactctagagtgtgttacatagaataaacatatagtataagccagacacaatggcacatgtctgtaatcccagctactggggaacctaaggcaggaggattgtttgagcccaggagttcaagaccagcctggacaatatagtgagcccttggctcaatttctttttaattacttggcatatgatatggtttcaatatttgtcccatccaaatcacatgttgaaatgtaatccccagtgttggagttggggcctggtgggaggtgtttgagtcatgggggtggatccctcatggcttcgtgctgtcctcacaatagtgagtaagtttttgagagatcttgttaagaatgtgtggcacctcccccgcactctctcttgctcccactcttgcagtatgagacacctgttcccccttcactttctgccacaattgttaagattcctgagccccaccctaccagaagccaagcagatgctggcaccatgattgtacagcctgcagaaccatgagccaattaaatctcttttctttat

SEQ ID NO: 47184 - DNA, 366 bp, Homo sapiens
tcagctcactgcagctgcctcctcctggattcaagcaattctcgggcttcccctctctagtagatgggactacaggcatgcaccaccacacctggccgatttttgtactttttgtagagatggggtttttgccatgttggccaggctggtctcgaactcccgggctcaagtgatcctcctgcctcagcctcccaaagtgctgggattacagccactgcacctggcctcccatttcaatttgttaatgcagcagaccaacccataaggggaggggcatctattgaagcattgaacatttttgcgctccacaccttgcctgtctagaaagattgagggagaccagtcagaaattgagcattgggcctg

SEQ ID NO: 47185 - DNA, 465 bp, Homo sapiens
gtggatctctctgattcatagcaggcttacagctggttatggaggccacagaattcaagatcaaggccccaggaggaaaaggtcaggaaaaggtgagcaaaagctagccagggagtcagaacccagctatatgaactgaagttaagtcaggactccagtgaggtatatgcaaatatccataggctcagtggggaacactgtagaatctggaacatgaatgatgagaactcactgagcaagtgttgcaggtagcaagaataactcatagccacagccactggtggaagaggctttgtctggattaaccaaacaactttggaacccacagttgaaagccttcaaggctgagaaagactgaatagaacccaaactaaaattgggatgtatgaatgtgaacttgtaatatgaaagttttccgaacttctaacctaaattcccttatctgagtgtaatggtatatattaa

SEQ ID NO: 47186 - DNA, 396 bp, Homo sapiens
ctcaaatgggtatttctgcaaattccagttctgcttatatactatttcctgatgaccctttctatctggacttcctgttggcagttcaaattaaacacataatcaaaatatttaatccaagactaaactcatcgtcatccctccaaaacctttcttggactcaacagtttctcttcctgctctcatcactattccgatcacccaggctcaaaacctagggtgcattcttccagcttctgctcaggtttttgagcccagcatccttcactgccctccattcctccctcactggtcttgctgccaccaccttcttaactcttccctaggggaattcattcacctgctccagtttctccgcactccagtttatcttatactttgtgatgatttaattaa

SEQ ID NO: 47187 - DNA, 438 bp, Homo sapiens
agctcacactttctattgtcagtcttggatatcatcccaaatgtcactttctcaagaatcgtttaagataaacagttgtattatcagccacaaagaagattaaaaaaaaaaattgcccaagatcatacagtttagaaatggcagagtcagatccaaacttgggcagttttgctccagaagtctttatcgccactgatttatgcttcccctacattgtaattgcctgttcaacagtttgccccactatgagcacctttggggtattgtttgcttgtttgtttgtgacggagtcttgctctgtagcccaggctggagtgccatggcgcgatctcagctcactgcaacctccacctcccgggttcaagcgattctcctgcctcagcctcccgagcagctgggattacaggcacgcaccaccacgtccagctaatttttgta

SEQ ID NO: 47188 - DNA, 398 bp, Homo sapiens
taggatgcttctggttgtcacccattttgggccttccatacatagtacactgtaaatgctttcattgtagtacttgccacaccatattctaattcagagcttgccaacagtttctcaactcagatgtgccaggaaacccattctctttcctgctggagagtggaactgggcctctgtcctacatgggttgaccagggctgtgagcaacttcctttgtgcatcccagtaccataagtgtcatttcagtgtgtggaaatagtgagaattgccctctaatcaatagtacatttgactatttccccagcaagacgactttgaaggcaggctaattagctggaaattgaacttgtcacccaggcctctggctcagtgttcttggtcgttttcttacctcactg

SEQ ID NO: 47189 - DNA, 303 bp, Homo sapiens
gtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccc

SEQ ID NO: 47190 - DNA, 301 bp, Homo sapiens
gctcgctgtaaggcaagaatgcctgaaatgtttagctggcattctttgtgtttctagataaagcaaaacatgtgctatgcatgctggacacgccccgtgccgtcttctgtaataaaagcagcaaccatatggtactgccggaaccttccagtatctcctataaacctcaagagccttgcagatctaaaactgcatagagagcacagatgctctggctggggtggcacaggtacacaggtggaagacaaaggtcaggccttatcgtgctagagcttacatcaggctaattcctctaccattg

SEQ ID NO: 47191 - DNA, 414 bp, Homo sapiens
ctgaaacagtttccacttccagtcaagacggagtaatagggaccagatttactgtcctaccttaaagtaccagaaagctgaacaaaacatacaaagtttcagacactcaacaatagttataagaaaaggaaggcaaaggaggtgactccaacaactgccccagcttactgccgagtttccagactatggcacagggaggggatgcccaaacagctcgggaagtcgccctgagcagctgagatgggagtgagaatttagggaggccacactggctgaattcacagcaggagtacctgagaagagagtgctgcagaccagcaggggctccctcaaattttcagctggcactgaacagcacatgcgtatgagaaaactatccaaatcccggagaaaaaacattgaaaaggaataggt

SEQ ID NO: 47192 - DNA, 1287 bp, Homo sapiens
ttgacagcctagtactagtagttaccacttacatgtttattttcagaatttaggtatgaaagcaagaaatgtatagtttatatcagtggacctgaaatgaaaaacgttgttaagatgcattaactttttaaattctttccttttgagcatcaaactttaaatttccctggaagaaggtgaaattgatagtacttaagtgtaagtgtggagtataatgtgcagatgtgtaagagtctgaaataatttcttgtgtgttttttttttttctgtttgtttcggacaaaaaaaaacaccgtggtcttcccatgcacagttagctagacaagatcactaactaggttttcaggtaagcatgctgacttttccatgtttgtgggacattcaggtagaaatactcaatatgtggagttcagaagagaggtctgtgctggaaataaagatttgagagttctcatattgggaattattggagggttattatgagaataagaagagaagaaggtaaaaggaagccctgaagaacattgtcatttaagaagaagacagagttttggaaccagtctgggcaaaacagtgagatcacgtctctgttatttaaataaataaataaataggtgacagaggaagaagagtttgtaagtttaaatgagagaggagccaggagtgactgggttgcctcagaaagtacagggatattggctgggtgcagtggctcatgcctataattctagctctttgggagggcagggtgggagatttgcttgagctcgggagtttcagtctacagtgagctgggatcatgccactctagtccagcctgggtgacagagtaagactctttctcacacaaaaaaaaaaagaaaaaaagaaaaaagtagtcaggggtgtcaaattcaacatggcagtcaagaaaagtattacggtccgcattgggattacaggcgtgagccacagccactggcctaaatattctcctttagtagaatcctcattatgcattttaagtaggttcatttggaatcaggtgttccacttaattttcaatagtctttcattgttaaagacgtacagtaaaatgcttctaggtcaaagtttaatgccttgtagtgttttaatatacgttcagcctggctgttgacaaaaacccttgatttcttcttattatttttaactcctccacccccaactcttgatttcttttgtggaaatataattcagtttttttgtgacaattttgtcctggtcattcaaaatctattaagatatagggaactatgtagactgact

SEQ ID NO: 47193 - DNA, 178 bp, Homo sapiens
ggaaattctactctcagacttctggtttgaataactataaagtggtgccatttattgttgatgtttataaataaatgttttggtaattttaaggattagaaaacagacacttggccattcgaaataagtatacttatatcctggttaagatttaggtggcaggccagacacagggctc

SEQ ID NO: 47194 - DNA, 220 bp, Homo sapiens
gatgtatagcagaaaaagtctgtaacactaattcctcttatggatgtggagactgaggtccagaggctgtggtcatactcaaagttatacgcagaattcgaggcaaaaactcagtcccaaatctgatatttctcccttaattctgtgcactccattcattacactttgaagattctcagcacttgaaaagcaggaactttatatctctcacatgcctcac

SEQ ID NO: 47195 - DNA, 404 bp, Homo sapiens
  misc_feature (356)..(356): n is a, c, g, or t
agtagtagaagtggcagcagttagcatctactgtagttgcaggattcagtaaatggtaagtatgtgctaacacctaattaaggactttagcatgcattattattttttaaattctcacagcagtatcaagatatagaaactattatctcttttacgattgaggaaactgaggccgagcaaagttaatcagcttgcctagacagtggcaaaataaggatatgaactaaaataatctgagtacagacctttgctgttgatcactctgtcatacaaactccttatgtttctctccccctcccccgttaagatcaagcttctcattgacatgttcatcacagtgtctcagtctgggtccnttacatactaggggaacttgtttatattcttttgcagttatctttttt

SEQ ID NO: 47196 - DNA, 649 bp, Homo sapiens
ctcagaacctgctgaccggtactagttatgctgtcttgccatagtagtgcagttctttaaaatgttgatacttgctctcttatcaaaggttggtttttttgtttttttgtcaagacagggtctcactatgtcacccatactggagtacaatggtgtaatcttggcttactgcaacctccaccttctgggctcaagctggcctctcacctcagccttccaagtagctgggaccacacccagtcaattttttattttttattttttaatttatttttattattactttttttgtagagagagggtttcgccatgtagcccatgctggtcttgaactcctgggctcaagctgtctgcccacctggacctcccaaagtgctgagattacaggcatgagccaccgcacccagcccaaataaagttttaagaaattacttggccaggcatagtggggcctttgtagaaaaacatagcttttctatgagaagatgatcaatattttcttttcctttgaatttggaattaccattttggaactgttgtcaacaatgcataataatatatcagaatgcttcctagtatattattggagaaagaacaaacaaaagtttaaattgatataaaatgcatataatggaacaagcaaccctgc

SEQ ID NO: 47197 - DNA, 801 bp, Homo sapiens
ctcagaacctgctgaccggtactagttatgctgtcttgccatagtagtgcagttctttaaaatgttgatacttgctctcttatcaaaggttggtttttttgtttttttgtcaagacagggtctcactatgtcacccatactggagtacaatggtgtaatcttggcttactgcaacctccaccttctgggctcaagctggcctctcacctcagccttccaagtagctgggaccacacccagtcaattttttattttttattttttaatttatttttattattactttttttgtagagagagggtttcgccatgtagcccatgctggtcttgaactcctgggctcaagctgtctgcccacctggacctcccaaagtgctgagattacaggcatgagccaccgcacccagcccaaataaagttttaagaaattacttggccaggcatagtggggcctttgtagaaaaacatagcttttctatgagaagatgatcaatattttcttttcctttgaatttggaattaccattttggaactgttgtcaacaatgcataataatatatcagaatgcttcctagtatattattggagaaagaacaaacaaaagtttaaattgatataaaatgcatataatggaacaagcaaccctgcaaaaaaaaaaatatatatatatatataccatctgggaatttctgataataacattgaaatctgttcacacagtctaaaattcttttgatgtatcgtagttttgaaaaaaaggtaacagtttactatatataacaaatataaggaaaatatta

SEQ ID NO: 47198 - DNA, 385 bp, Homo sapiens
cctcaccctagtcccagctctgcttttcctcatcacttctttcttcccctgcaatcaccttaattcaattatttattactatttatacctgggtatttcaacaattttctaatttgtcagtctaattgcaatttttcccttctctaacctatcaatacatatccaagtcttctttaaaataactctctctgtatccaaaatctgtgaagagtcttactgattacctaatatagttcatatctcccagaagaagaaatagtcatataataccatattaaggcttattgtctataagcaatagaaactgattctggggctaacttaagcagaaaaaaaaaagtttatttaaaagatgagtggtagatcccaaaatttaaagaaaaac

SEQ ID NO: 47199 - DNA, 162 bp, Homo sapiens
ctgtctccagcacccctgaaaggggacccttccctcttagcttagataccctcagtggtagggcacccactcctgcacgaggcagccctgctgctgttagtaagtcttttccttacattgaactcatctgcctccctgacgctgatctttcatctgccctgt

SEQ ID NO: 47200 - DNA, 475 bp, Homo sapiens
gtctctgcaggttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgacttgttgggggctaatagggagacattcagaaatgatcctgtattagccgggcatgatgactcatgcctgtaattccagcaccttgggaggccgaggcaggtggatcacatgaggccaacctggccaacacagcaaaaccctgtctctactaaaaatacaaaaattagcctggtgtggtggcacacacctgtagtctcagctactcgagaggctgaggtgggagaattgcttgaacccaggaggcagaggttgcagtgagccaagattgcacactgcactccagcctggatgacagagcgagact

SEQ ID NO: 47201 - DNA, 429 bp, Homo sapiens
gtctctgcaggttggtggtagatgggggtacccccgtatcaggctttggatttcgatgtcctcaagaaatgttccagaggatggaagacacatttcgattctgtgctcactgtagagcactccctagtgggctttcagactccaaggttctccggcactgtaagaggtgcagaaatgtctattactgtggtccagagtgccagaagtcagactggcccgcacacaggagggtttgtcaagagcttcgtcttgtggctgtggaccgtctcatggaatggcttctggtcacaggtgattttgttctaccctcaggaccttggccatggccacctgaagctgtacaggactgggactcctggttttctatgaaggggttacacctagatgctacattggatgctgtgctagttagtcatgctgtgaccacct

SEQ ID NO: 47202 - DNA, 274 bp, Homo sapiens
ctgattttttgtagtatactagtttaattccattctttctttttctgtgtatttttaagttgttttctcagtggttaccttggttaacccagctactggttacctcagttagcatcttaagcttaaaagaacctggctttatgaataaagccaacctcttttcaataatatacactctgctactatgtatttctgtctcttcttctttatattgttgtagactgcatctttatacattgtgtacctgttaatacagacttaaattatatagggt

SEQ ID NO: 47203 - DNA, 848 bp, Homo sapiens
attgcttgtgccagaagtttgagaccagcctgggcaatatggcgagaccctgtctctataaaaaaattttttttaattagacgggcatggtggtgtacgcctgtggtcccagatacttgggaggctgagactgaggcaggaaagttgcttgagcccagatggctgaggctgcagtaagccatgttaatgccactgcactctggcctaggcaatagagtaaaatcctgtctcaaaaagaaagtaagaaagaaagaataataaagccaacacccatccaagcaacataaggtcaaaacacagcagtaacctaaaagttctccatgtgtccttcaccaaacacatcctccatcctccctagggatgaccactatcttgactttgtataataatttccctacgctttataatagttttattgtcctgtatatcccctaaatactgaattcagttgtaccctggttttgttaccttatttggggtacagaccttcttaagagtgatggcattgttattaaatttcagagaagcataactggtcagtaggagggtggagacagatgtataagccaaaaatttttaaggaatttaaggagtggaacctagaaaaggtgttaggtagaaataaggtttctctgtttatacatgtattaaatgaaaatatgaggtttgactcatattttaaaatattttgtacattttgcttaatattaaaagcattttttctgtggcatgaccataaatatttataaggtaagacaaatatgacttatttatttttagtgtggcacagctgaactacatttcaaatgagaagtaacattgatagggagcagtaatgtgaaactatg

SEQ ID NO: 47204 - DNA, 399 bp, Homo sapiens
attcagggcttctctggaataacagctgaaacccagtgagtgctcaaatccagtaactcatgtcaccaccgtctgagtatcatataatgccatcatttgactctgagcctcttttagtgttcagaatgcagtgattttttctgcctcacaactggccatgggaatgctgcagaactttacagagacaactcactgctcggtgtgggaacttgataggattataattttcagatgatgctctgtaactgtagattttttcgatgtgacttatttgtgcttccatattattacattcgtagagagtagcagagtgacagtattttgtggttgctaagaagtccatgaaaagagtccagaaacagaattttattttgtctttcttctaaaatgatttagact

SEQ ID NO: 47205 - DNA, 367 bp, Homo sapiens
tttatttcacttattcattattcccttcctctgctttttaaaattttgtccactgctctgtctttaacttcttaagaagttaaattatatcattgattttcagaatttttatggtgaatgttaaatggtgcagctaagtttcacaagcttatttcacaaatgtagaattcagtaaagtggtgttgatagaggaaaatctgggtcctgagagggggctatgttagagatattttgtggaataccttttgcatgatattaataattctaacctaaattaagcccaattaattttcctatcctaatatatgcattaaagattataagtccccacctaacatggctttactgaatcttacaagttttaggt

SEQ ID NO: 47206 - DNA, 382 bp, Homo sapiens
gaacggaccagatcatactcagtggtatccttggggcccatgtcaggccttctaaggaatgaagaaatgatttaggaagctctacacctcccgtaggaatttgggaaagtgcctgaatcccaggtggccctaagtgtagagatggtggctgtgcaggctgcccctcctgtaccatctccccagtgcctggcatggtgccctgtgggtgctgaggtgggtgcctctcaccatgaaggcgggatggagtgttctgggcctgctggtgacccacttaccccatggcctggagttcaattgcaagcctgagggctagagagggcccagcatgggacaccccctggggagtatggggtgacgtggcttccttgtgagagttaaatca

SEQ ID NO: 47207 - DNA, 861 bp, Homo sapiens
atcattaaaacaacagggtagaagaagagtaatcaaaagtacaagaggaaaatgctacctctgtctaggaaaattagggagggcctcacatataaaccaacaactgggctagatctcaaaggacagacagggattaaccaggaagaataaaaacaagagaagctaatgtggagaaccagggaaaatacagtatgatgaatgtgggcccaatgagaaattcagcatagccagagcagagcacaagaagcgaggggctagagaagaggcaaggatattaaactgaagttatatagtaaagacccttttatactagaccaagaatattggggccaggcgtggtggctcacacctgtaatcccagactttgggaggccaaggcaggcggatcatgaggtcaggagatcgagaccatcctggctaacacagtgaaaccccatctctactaaaaatacaaaaaattagccgggcatggtggcgggcgcctgtagtcccagctactcaggaggctgaggcaggagaatagcatgaacccagggggcggagcttgcagtgaactgagatggtgccactgcactccagcctgggcgacagcacaggaaagaaaggtaagcagtagaaaggctgttacaacaggctaggcaagaaataatatggatctaaactagtgaaaatgagaagatggattacagaggcattttaaaaaggtaggctatagagaacatactaaagtactaaagtcattaagaaggacaggaacaaagcggatcttttgcatgggatgggggattatgaatatgattttttagacatacacattcccccatcccacctctacctgttttatttattctaaaaaaaaaa

SEQ ID NO: 47208 - DNA, 498 bp, Homo sapiens
gctcagctcctctgaggttgacactgaaaaagagtaactgcaggggccagaagcagagagaccaacaaaccctggcccctgccctggagattcatctttctcccgagactctccctctgatgattttggctccatcgaagcctccttgggtcatttcttccttcatatctgaggtacaggcaatgggatgacaaaaggcatttttcaacatctctccacaactaagtcaaagctgaaaagtttaaaggacttttctgaacatgagggcaatgtttcccaaccttttgaggtcatagaaactgctctggacaccagtttaaatatacagaatcttgggggacatggattttgaaggtctgcagtgggagcctgggaaaaggtattttaaagtaataccggttacccttaaatttctgcaagttctagtatcactgtgctggcaagtaacaaagagaaataaacacagtagcataaagcctggcatgtagcctggctcac

SEQ ID NO: 47209 - DNA, 850 bp, Homo sapiens
  misc_feature (778)..(778): n is a, c, g, or t
  misc_feature (824)..(824): n is a, c, g, or t
agtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccagggatgccatcaacataagagacgtcctcatccagcagggctatgccgaggctcacgggaggagtcctacggagtccaaggcaaagccatngaagtttttcaaggggcctctttttccaagttcagttaggaaaacntgacagtgggctctgtggccttttcc

SEQ ID NO: 47210 - DNA, 609 bp, Homo sapiens
aaaacaatacatatttactcttttacagaggccagacatgtaaaatcagtttcactgggccgagatcaaggttgcaacagggctgggctccctccagaggccctaggagacaatttgtaccttgcctcttctagcttgtggtagctactggcataccttgtcttgtagccacatcactctaatctgcctccatggtcacactgccttcttattttctgtggacaaatctctgtctccctcttataaggatacatgtgattgcacttagtgaccacccagaatccaggaaaatcttctcaagatccttaatttaatcacatcttcaaactcctttttggcacacaaggtagtattttcaggtttccagagattagaacatggaaatctttaagaagaccattattcagtctagaacatcttctattactaatttgttttattttgttcatgaaaagatgttggattttgtcaattgctttttctacattgattaagaaaattacgtgttttcaaattattaataattctgttaatattgtacattacattgattttgatatgttgaatcaatcctgcattcctggaataaatcccacttcatcatggtgt

SEQ ID NO: 47211 - DNA, 1071 bp, Homo sapiens
aatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatggccacatgtttacctatgtaacctgcaaatcctgcacatgtaccctggaacttaaaataaaaattataattaaaaaaagaattgagtagctgcaccactagaaagatggcagagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaataagagtgggcttcctcaaggagatgggcacacctggctatcggggtgaacgcatcaatcagctcatccgtcagctgaactagacccaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccg

SEQ ID NO: 47212 - DNA, 790 bp, Homo sapiens
tccctttggttccagaaaatctcctgaaaaagaggaaggcttatcaagccctcaaagccacccaggcaaagcaggcacttatggcagagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaataagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagtt

SEQ ID NO: 47213 - DNA, 334 bp, Homo sapiens
ttttgttttaggaaggacataagacctgtgaagagaacacatttgtggttttttttgttttaatccaggtattcaaatcagttcattttaatttggcaaacactgattctcttttactctctgtaaggtacttaatgggcactccttccctttgtcctcatggcctcattgtgtatatggttagtaatgatttgttatatggaaaatatcactagccaatttctcaacataaaaagtagctgcttgtttgttaacatcccttcctttagagaggcctttatacattgcatggaatatttacaattacttatattatgatcagtgttaaacttgt

SEQ ID NO: 47214 - DNA, 327 bp, Homo sapiens
ggtgtgggtcctgaaggatgaggagttactccttgcataataaaatactgagttttttttttttaaaaaaaactggtttaaataagtggtaaaattattggacatattttttgcaatagaaatgacattttgagtttctataacaaacctatgctaacaaaagtcttcaggtgacctttccaatctccaatttgtatttgaatctgcattttacctttttttctctgtctctggatgtaatccctttctgcttatttagtctttcagttttcttatgttctgatcctccgttccccacttactgtagagggttggtgggtttgtagc

SEQ ID NO: 47215 - DNA, 693 bp, Homo sapiens
aacagactgtcggaaacactgtgggttaatttactgccatgtggcctgcagctctggtttggaactgcttggagcaatgctaaggtggaagggtcatcgtccgcatcaacgtgggaatctagatcataaacaaatgtcttgtggggttccttgcaggggctccccaggtcagctgttttgcaggggggatactccttgaggctgctacttttaattccaggagaatatattccttcattcgagttcatgcaatctttataaccccatttggttatcactgatgggggttcaagtaacacttttcgcttctgtagctttcttagcccttccaaaatgtggctttccttgatacgagttggaggtagttcatttgtaggactagcaaagccacttgggagcgaagaatcaatacttagccttttatcccagttttgtgatgattgctaggaaagaaaagtagacatcagaaatgattgaaccatgtagatcacaaagatataaaaggaaaagtacatcatgggacttaatttgtgctagtggttggtaactattcacatataaatgcctacattaattagctaattaatttattcacaaactatgcagcaaacattgattttgccaggtcctgtgctaagaagcacagcgatctaaagaaacagaaggtaaaggccctgtcttcatgggaggaat

SEQ ID NO: 47216 - DNA, 353 bp, Homo sapiens
ctggaccccacttgctccagctttgcacatggcctaccctccccttactttccttcaggcgccttgcctaaaataccgtcctctcaatgaggcctaccctgagcaccctgtttaaaattgtaacctgccgttccctccccctacaagctttcaaatttcgtcatctttttttagtttttgctataacaattaatcactttctaatatactaattctaataagaatttacttatttatatatttattgcttaacgtctatatctgtctgtgagaatataaggcccatgaagtcagggatctttttctgttcttaacattgttgtattccaaatgggagactgttgcttggctca

SEQ ID NO: 47217 - DNA, 690 bp, Homo sapiens
catgaagagaagaatcactttccataaggaaatccaagaagtgcccattacaataaatgcatgctattacggattgaactgtgtccccctactgaaaggtatgttaagtcctcacctcctgtacctaagaacatggccttatttggaaatagggtggttgcagattaactagttagagtgagaccatactggagtaggctgggtcctaaatacagaatgcctggtgtccttataagaagagagggaggccccgggaaaagccggcccatctgaagatggtggcggagactggatgagggatctgtaagccaacgactgacaggtgtccctgagaacctccagaagctggaagaggcatgaaaggaatctcgccaggaggctgaagagggaacatggccttgcccacacagatttcagacatctggctccagaactgtgggaggacacatttctgttgtttagaactgcctgttttttatactttgttatggctgccctaggaaactaatacagatattattttccacttctgaacttagcaaaatatttttaaaatgaaaattcttaaatgttggcacagtttaaggtcaggggtgccccagcagtttggcaacatatatcaaaggctttaagacactttatcctctttcacttggtaattccatttttaagcctttatcctagggaaaa

SEQ ID NO: 47218 - DNA, 294 bp, Homo sapiens
ggtctcgatctcctgacctcatgatccgcccgcctcggcctcccagagtgctgggattacaggcgtgagccaccacgcccggccttcccacctcactttttaccttttatgtcatctcctgggtcatgtaaattaacacctacttcagatgggtatggatttctaaatatggattaaacatggatttttaaaataaaggaggactgaggaaatggtcacatcaattctggacgagaagacagtttttatgaaacagttccattttaaagacacgtctaatcagagttgggaatc

SEQ ID NO: 47219 - DNA, 995 bp, Homo sapiens
ctggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 47220 - DNA, 472 bp, Homo sapiens
ctaatttcaaatatcttttcatatgttcatgtccatttgtatatcctattccctgaaaagaaaaactattgtttttttatatttttcttcagattttgtttttatgtaataagcatttgtttgttaggtgtactgccaatatattcctccatcatgttgcttgtctttcatctttgcatgtgatgcttttgttatatagaagttttatatttttgatgtagccaggtttattgaccttttatctttatgacttttttgcctttaattttgctttacattgaggtgtttgtgtatccactgtttttcttttgaatggtatgagaaagggatttaacttaaaaaaagtaatacagctaggcatagtggctcacacctgtaatcttaacacttggggaggcagaagcaggaggattgcttgaatctaggagttcaagaccagcttgggcaacatagtaagaccctacctctgcaa

SEQ ID NO: 47221 - DNA, 494 bp, Homo sapiens
ttttagtctgtcacctggaagtggcttataatataaatttgaatagtgaagcacttaagatgggaaggcaatttaggaagttattggaattttccaactgagaaataatgaaggccatttggatctgtcatagattttgcctctggccacccaattattttctcactcgattattgctttttctctgcttccatcactgttgccatactattttctttgtgatccgaggagatctgacttaataacacattttgcttcatgcattgggggcctaatgtcatacaaagtggatactgctcagagagtaaagccgatttcgagagctgacaagttgtcataaacttcctgggtgtcctgcttccatatacctccattcccattaacataaatcaggtcacccagactagaagactcagtcacagtgtaagctttgtgaaccatcctttcctcagttatttaaaatgatctgatttaatggaaaattcagcatcaag

SEQ ID NO: 47222 - DNA, 461 bp, Homo sapiens
catggattagtttgtcacttcacttattaagtagtttttgagcccactggataattctgttatataagccttggacaagttagtagtggattaactaatacttatcccccccaaacattatcaaaataggggatattcttttcctttatgtattaccttaagggcaaactggggcacaatttcaatgactgactcatgcattaatgttgagatgcaatatgaagatgttttatgaacctactttccacttgcctaactagggctgagagactattaaattagaaaaagaaacaaatgtttgtttaaaaatgttctgcagaaaatcttatggacttccttaagtgtaatagttatgataacccgatttaaataagaaacatactgaataaccacactatttttctaaaactgttagaagtctaatgaatacaaatgaaaattaatctgttcctttccttaca

SEQ ID NO: 47223 - DNA, 664 bp, Homo sapiens
ctgtggtctcaactacttgggaggctgatgtgggaggtttgcttgagctcggattgcaccactgcactctagcctgggcgacagtgtgagaccctttttcaaaacaaacaagcaactttttttgagctacagtatatttaatggttttaaatatgagtgcagagtaagagggagtccagtccataagatgacccttgcttctaatactagttgcaagtttgggggttcccaagaccactcttttttttttttgagacagggcctctctctgtcaccccggtgagagtgcagtggcatgatcacggctcactgcgccctgaactcctccctcccaggttcaggcagtcctcctacctcagccacctgagttgctggatctgtgggcacacaccacctcgcctggctagtttttctatattttttagagacagtttcaccatattgccaggctggtctcaaactcctgagctgaagtgatccgcctgcctgggcctcccgaagtgctgggattacaggcttgagtcactgtgcctggccaagaccactcttaggttggatgatttgccaggaggactcactagaactcaaaaaaaaaaagacaagacataccttggaaaatggggggaatagacagatgatttctatggataggaggtttatttgt

SEQ ID NO: 47224 - DNA, 561 bp, Homo sapiens
taatattgcagagcaaatttattttttacttcaaagaaaaatgctaattagccgattcactacttttaaagttattgtgaagcatatggcgcccagtgtgagatacatccaactgctaaaatagagcgaagaggaaattagcgaagaatgggctgtttggggtgagagtgggggtgggggaggaggataggttctcaggcagattctctagccttttcagaatgattttatcgcccatcactgtttcccgcctcctcatttacccacttcccccactaccaacccctgggccaacctcttctgggcctctagctcccctcccccactttggctggattcaggtgcgcacctcaggctagccaccagttcacacctggttctaagcaggttccaacactgctgcagccatctccattcacaggacctgtttaggaagtagacttttagcgaggaagccttcaccacaacagccaaactccccagaaaacactagctagtggctctataatgtggtttgctgagaaatataaggaaactggaaaaggcgggaaggggagggcg

SEQ ID NO: 47225 - DNA, 915 bp, Homo sapiens
cacccaccttggcctcccaacgtggtgggattacaggcggctgccaccacgcccagctaatttttttgtacttttggtagagatggggtttcaccatgttggccagactggtcttgaactcctgacctcaggcgattctgcccaccttggcctcctaacgtgctgggattacaggcatgagccaccgcgcccagccctattaaagggttttaagacaagacatggatagatgtatgctttataaggctcattctgggtcacagtggatacaggtaggtcttcatggagccttatgaaatggttactcagctcgaacagtcactagacctttgctgagctgggcataagtttggttcttggccctgttttgtcttccaaaattctgtttattcaacaagattcaaagttggcttctgacaccttcccctgctttagagaagactgcattttttttttttgctattattgttagagccacctgttacctttgcaaggaagctatggaacaaaacaatttacaggtgttccaggctgcagaatggtccttgggcagggcctactgggcaagtagctctgtatcactatagtccaggggctggctctcagctatggtaatctggaaatcagttatttttcagcacatgtgtaaagtgattgaactctggggagcagattcttgttaacctaaatcatgagagactcatgtaactaaagtgccaggtggttaatgctgagtaaagacaagagctgggagggggtctagacaggagttctggaggcaagcctacatgggaaagacaaaggagaaactgacgtagcgagttggttagatctcccttaagggccatccctgcagacctgttcaaggggactgatacttgagtcactggatgttatcagatattgtacaggtta

SEQ ID NO: 47226 - DNA, 3777 bp, Homo sapiens
  misc_feature (585)..(585): n is a, c, g, or t
  misc_feature (624)..(624): n is a, c, g, or t
  misc_feature (786)..(786): n is a, c, g, or t
cagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggcngccacactctcctgtaccctcaccagtgacctgggaccnggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgacngtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcataggtaccagccctgtcttcccccaactaaggcctgagagtccctggggttctgggccctccctgccatcaagggcaggcctgggatatgatctctgctggctctgatcctcatttgcatgctgtttaagatccagacctaccactaactctgctcagactgcttaggaagaagcagttgagatgaacacagtgctgggctcctgctgggggggaggagccggttatgcttctctgaccccaatacactgggccctcaggaagttgctgggtaggatggtggtccccagccctgagtggtgccagcaagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgccgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggacctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatctacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggacccttaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaata

SEQ ID NO: 47227 - DNA, 3582 bp, Homo sapiens
  misc_feature (585)..(585): n is a, c, g, or t
  misc_feature (624)..(624): n is a, c, g, or t
  misc_feature (786)..(786): n is a, c, g, or t
cagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggcngccacactctcctgtaccctcaccagtgacctgggaccnggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgacngtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcataggtaccagccctgtcttcccccaactaaggcctgagagtccctggggttctgggccctccctgccatcaagggcaggcctgggatatgatctctgctggctctgatcctcatttgcatgctgtttaagatccagacctaccactaactctgctcagactgcttaggaagaagcagttgagatgaacacagtgctgggctcctgctgggggggaggagccggttatgcttctctgaccccaatacactgggccctcaggaagttgctgggtaggatggtggtccccagccctgagtggtgccagcaagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgccgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaacatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatctacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggacccttaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaata

SEQ ID NO: 47228 - DNA, 4171 bp, Homo sapiens
  misc_feature (585)..(585): n is a, c, g, or t
  misc_feature (624)..(624): n is a, c, g, or t
  misc_feature (786)..(786): n is a, c, g, or t
cagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggcngccacactctcctgtaccctcaccagtgacctgggaccnggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgacngtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcataggtaccagccctgtcttcccccaactaaggcctgagagtccctggggttctgggccctccctgccatcaagggcaggcctgggatatgatctctgctggctctgatcctcatttgcatgctgtttaagatccagacctaccactaactctgctcagactgcttaggaagaagcagttgagatgaacacagtgctgggctcctgctgggggggaggagccggttatgcttctctgaccccaatacactgggccctcaggaagttgctgggtaggatggtggtccccagccctgagtggtgccagcaagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgccgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaacatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatctacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggacccttaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaataaaaaaaaaaaaaaaaaaaaaaaaaaaagaaaagaaataaaaaaaaaaaaaacaaacaagaacaaaagaagagagggggggccgcgcgccgacgaaagattactgccctggcggaggagccccacgacagatgacggcgagccaccgcacgcttgtgtgtgtagtaacaagagcgggggcgcccacatagaggagagcgagcgcccttattaaaaaagaacgcacggcgacgcgcggcgcccgcgcagtgattaaaacaaacgcccgacgaggccgagtgggagcgaaaaaaaaccgcgctgctgcaatgctgagtggggagagatacacatctatttggtggttgaagaggggagcgaacccccatataactatctgtgtgtggggggggggtgtgagacaaaaataaatttagggggcgacagacagaaatattgtatctcacggaccgggaggaatatttagatgacaggctgctctgtaggaagggaggggagagatcattgctataacgaggagtattcttacagcggggcggctatattatacagtggggggtgaaaaacgaaagatgcgacgcaagatatctt

SEQ ID NO: 47229 - DNA, 598 bp, Homo sapiens
ccttgcagggacgggtccggaattcccggggtcgactactactactaaattcgcggccgcgtaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47230 - DNA, 505 bp, Homo sapiens
aaaaaaaaaaaaaaaaattttttgggggggttttttttgggggggggcctttaaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47231 - DNA, 3441 bp, Homo sapiens
ctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47232 - DNA, 3499 bp, Homo sapiens
ctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctcccttccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47233 - DNA, 3347 bp, Homo sapiens
ctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47234 - DNA, 2077 bp, Homo sapiens
ctctgcatgcctggggtactaaagatgctggcgacataattagcggcagcaacggtgttcccagtagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47235 - DNA, 1227 bp, Homo sapiens
gtcagccataggacaggcctcctgcacacctagggaaggctggctaatcatgtccccaccctccatggccacctccgtgcaccagaaatcagggtaagctgggtgtccctggccatgcaagttcttagctgtgtcctctgacctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47236 - DNA, 3566 bp, Homo sapiens
ctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47237 - DNA, 3545 bp, Homo sapiens
ctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47238 - DNA, 2072 bp, Homo sapiens
gcggccctactactactactaaattcgcaaccagtcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggaaaaatcttttctttttgccttttggccctaggatcgtgtttaggaggat

SEQ ID NO: 47239 - DNA, 632 bp, Homo sapiens
cgatgtagggagtgagtccggaaggggaatcctcggatctcccacaggatggggatgggggtgttaaggaggagtcctgaaaacctccttgtttctccgacctctcctgaacacaggactcttttctgcctcagtttccctgcttcattaatctgagtacaacccgactgaccctcatataaaaaacttgacactaacagcttgggcacacccgtgaagattcagggatggggacttcaaatggaaaggtggtcgtttaatcattctgcatttcttccagactccaatccaaattctgggttgctgggactgtggtctgagagaagaactcggaagtggaaggctgggactgcagataggaaccgttagccatgcagcctgggattagggaaggggtgacgccagcactccctgagctgcccagactggtgtctcagtaggtcctgtgccccccgcagtctactgtctccgggcccagctcagcactaggacttgcagtccttgtggcctacacttgggattgggcataggaaatagagttaggggccgggtgaggtggttcacgcctgtaatcccaacactttaggaggccaaggggggtggatcacctgaggtcagggagtcaagaccag

SEQ ID NO: 47240 - DNA, 263 bp, Homo sapiens
attaaacagtgtacttttaaataacccatgagcccaagaaaaaaaatgttacaggtaagattagaaaatattttaaatagaatgaaaatgaaaacaacatgctaaaatttgtgggatacacctcaatcgatgttagaaattatagctttgcttatatttataaaagtacaaaatcactgataaaagatttcaccttaggaaaccagaagataaagagcaaattaaagccaaataagcataatagcaaggcaataataatagtg

SEQ ID NO: 47241 - DNA, 545 bp, Homo sapiens
taatgttttaagaaagtttaagtatttgtgttgggctgcattcaaagctgtcctgggccacatgccacccatgggctgcaggttggaaaagcttgacctggattcttctagctaattgtgagtataggagaaggccgtctgtttactgcttctggagccctctgcgtaagtgcaattaggaacgagtggaaacaatgaggaggggagcataagaatagcttggttgtgaccactggaacccaaagcagcacttgtcttgtcagcgctgtgttatcaatcaggaaggcagccgtggcttctcccgggaggcaggcaccaagatgaggaagcctgaagttctgggccctgcagagtcctttcagtgcaggggggcagagagaaggagcgtgaggagacccacatgggaggcatgcaggaggccctctgtgtatgtctatggaatgggcccctcaaggagccgctaagcagcgggaaactccacccactggcttattctcacccctgggctcctccatcccctcacccttcatagagcccaaaacaaa

SEQ ID NO: 47242 - DNA, 704 bp, Homo sapiens
ggttccagttttattagctacatagcctgcaagcagagagcacggtggcaccaaccaaccaggctgtatttggggactgtcgcttatttttcatgcacttggtgctgaggcttgaattggtacaataagatgcaatacctgcccaacatttcttattcagggcctagttaaaccttgaactgggaagaagcagcctttgtttgggggagcgtgttcttctgcagcagatccttttggttgaaccatgaaataataagactcggtttgcacaactgtgaatgcccaagttggctgaattcttggtacagaggcagagggacgggatgcctgtctttggaaatatgaacgtactggctgctttgttcacgatgactcagtgtttgtatgaccttggttttactaaacatctgaaggcacttttgtcaggtgtcctccatttgcccaatgtaaccgtattttatttctgagacacagtcgtgccctttaacacagtctgtttttcgaggaggaggattcacttaccgcccttgaaaaccaaggtcagtctggggctggtgatgggcatttggactgttccttgggttcaaggtgattttctcttacaaagttttcaccctctgtaattggcctcggaagaccacacataaataaggaaagacagttttctgtatgccggtcctcttcacctctggactgtggtgggc

SEQ ID NO: 47243 - DNA, 121 bp, Homo sapiens
tgtttttaggaaatattatagtaataaaatttgactggttactgtgtgcctgagatggtgtctaagccctttacattatttaactcgtttattttcacaattctatgaagtaaatcgtatt

SEQ ID NO: 47244 - DNA, 389 bp, Homo sapiens
ttgctaacagaacactgagaacagtgccagcccctgtctaagcatgtcctgtgtattaactcacatgatcttaagagtatttgcagaagggcagtagcctgctctgtcaacccctagcaaaatgacacctggagggcaaccaggcttgcaaagcacccccgaagggctgagcagcccctgaggttgacagctcatcaactccctcagctcagccagctttcacgttgtcagacctgcttaatggcagaaggcacaggtatcttgtggcgaatgtgcctggttctctcaacacgaccacacagattttgccttggacactggctgcttcttactttgatcaagatgactgatcgctaagaaacctgggcagttgaggcggctttctagag

SEQ ID NO: 47245 - DNA, 566 bp, Homo sapiens
tgcctagaaatcacatatatgtttatatattatatatttaagtaagaaaaaaacccttttgacctctttggatatgtattctacatatctacatagcaccagattttctgaagtgaaaaagtaaaagaccctgatttaagtaatatatatcatttaatgactataatatctgtttatttttttaaatattgaattaactctttctttctaaaatatgtttcatactccttagtttttttctactctaggtacaacttttcaaccttttttatatttcaaagtccagtggtattaagtatgaaatggtgcttaacctcaaatgttagaaatataaagcttatcctaagtagtttctgaaaagattgcaatctgcttggaattttcttttttatatattaattttcatttttacaagaaatccattgtgtttaaattcccttaacagtacattcaaaatcaggaatattacactttcattgcccatctttacaattgttattaacttctcagggtaattttaagcattggtaataccttaaataaattgctttttgtaaacacttaga

SEQ ID NO: 47246 - DNA, 909 bp, Homo sapiens
agctgaaactgtcatccttgaatttctcctcaggacagttctcctattctccaggagaccttcaaagtcccttccaactctgaaattttaagattctatgaaatgtagacgtatggagtgaggtttcaggcagttttgaaaggatcataactgtagtttccatttgcattaagtgtgaattgtactgaagtgggtgttctttggtgtaccccataatatctcaaacattatttggtatacagtacatactcattaagaattatagcctcattagactatgatatagattagtcaatctcaattctgatcatttaaactccattatatgctattaccaaatattaatcttttaaacaacagaaataattcatatatttgtaaaataaaatcaaaaacatagataggaaattgttaaaggtttaaattaaactctaaattccatgagagttgttgggcaagtcttcctttttctatgcacaactccctctggagtttttaaccctgtaccatgaaaattcctgatgagcaaaaacttgaaagcaaggtatgggaaagagttacaaatactctggtccaagctaaaatcacttgtggggatgatgcaacctcaatttaacagaaactacaacatcttccccttagtatgacaataaacttccagagaaaaatgcaagaaacaagaatgcctagagctgagagggagagttgggttaggagtgatggctaaggagtgcatggtttctttttgaggttattaaaatgttctaagagtgactgtggtgatgaatatataactctgaatatcctaatgaatatataactgtgaatttactaaaagtcactgaatttgtacacttcaagtggcaaattatatggtatgtgaattatatctcaaagctgatttaaaaa

SEQ ID NO: 47247 - DNA, 416 bp, Homo sapiens
tctcttctctctttttccaacgacttccacttctctctctagtttacatgtctccaaaccttaagcctctgttaatactttcacaataagtcaattttgccaacggtttgcctcccctagaccatctaggctgggcccagaacacctcatcttcactcccactgaagtgttcctgaaggtcagctctcactgaccttgattctgctcccctacactgtcaccagaagctatccacctatggttctaattcagtaagtccaactctctcaccccctttttttgtctcagctgtgtgggctttcccaggatggcatgcaatgggacccctgtgccatgcatattgtaaaggaaaatgcctccctccatgcgctacaaaacagcacatttatgatggcactttgaaaagatatgggttg

SEQ ID NO: 47248 - DNA, 385 bp, Homo sapiens
aaacttgaagatactaaagacagaatacaataaaatgctgtgtgtgaactttggaccctagtgttttaaggaaagctataaaagacattaaggggacaaatgagagaaatctggatatgaataatatatgataatgtctgaaaattactgtttattttcttagatgctacaatggtattgtaccaactttgaggaatatgctgtgatattgaaaataaattgccatgtttacaattgactttattatggatcaatgggaaaaaagaagtagaaaaaacaaacactgcaaatgtcacaactgttaaatcgctgtatttttcattcatactatactttcaacaattaaaaaaatatatatatattttaatagagatggagtcttgct

SEQ ID NO: 47249 - DNA, 1226 bp, Homo sapiens
ggaaagaatatttgcaaactatccatctgtattaggccattcttgaagtactataaagaaatacgtgagactgggtaatttataaagaagaggtttaattggctcacagttttgcaggctgtacaggaagcatggtgctaacatctgatcagcttgtagggaggcatcaggaagcttccaaccattgtggaaggcaaaaggggaataagtatctcacatggcaggagcaagggcaaagagagggggagggaggtgccacacacttaaccagatcttgtgagtactcaggtcttgtgagggttgcctgaggtccagggataccccatttaccctgatgtgttcatatacatttccatgactgtatcaaaatatctcatgtacccccataaacatatacacctatttgtacccacaaaaatttaaaaataatttcaatgtttgaagactcattattaaaataatagcagtttctataaatttaatatttcaataaaactcccaatatttattcttaacactggaaaaacttttccaaaatgcatatggcagaaatatgggcgttgatgaaaggacagcatcaattaatgagggatcctcccccttgacgaaaataccttccaccaagacccacctttaatgctgaggattacatctcaaaatgagatttgggcagggacaaatatccaaactatatcactagctatatcaggagctgtaactataactatatcaggaactataacaattctatagaaaaaaaattaatctgaaaactggacaaaaatctgaataggcatttctcgaaagaagacatacaaatggcaaacaggcatatgaaaatgtactcaacatcattgatccattagagaaatgcaaatcaaaactacaatgagatatcatctcaccccagttaaaatatcttctgtccaaaagacaggtaacaacaaatgctgaagaggatgtggagaaaagggaaccctcgtgcactgtggaagtgtatattagtacaaccactatggagaacagtttgtaggtacctcaaaaactaaaaatagagttaccatacaatccagcaattccactggtaggtatataccccaaagaaaggaaatcagtatattgaagataaatctgcaccatgtttactgtagcactactcgcaatagccaagatttggaagcaatccaagtgtccatcagcagatgaatggataaataaaatatggt

SEQ ID NO: 47250 - DNA, 401 bp, Homo sapiens
catatgtgagatataagacactatagcttctgctgttactttagtgtcctctctaagttgaaactctcaacagctcagtgaagtatctataaaggatattatcaccacttaggggatatgtgacttgccgaaaatcacccagtaagcttgtgatagagctcgaactagaatctaggcctcctaatacctagttcctttttttccttctattttagtgttcaaagttatgagtatggaaccacatttctaattatcattagccagaagatacacatgactgttctgagatgtctttttttttttttttttttgaaacggagtctcgctctgttgcccaggctggagtgcagtggcgtgatctcggctcactgcaagctccgcctcctgggttcacgccattc

SEQ ID NO: 47251 - DNA, 223 bp, Homo sapiens
tgtttaccaaaacttctaaatcactgggaaaacataaggtcaggattatgagtaaaattaatgtaaccactgagtaaatagagaatatttttaataagtttgaaaatcagattaaaagatcatggttactttgaggcctaaacattaaaaatctgctatattaaaataatgtacataggctgggtgtggtggctcatgccagtaatcccagcactttgggagg

SEQ ID NO: 47252 - DNA, 509 bp, Homo sapiens
taaatggcaaagaaagtaaagtctcaaatttcttgcttatgtgtcattatgccataaagttggggacatatttccaatttgtccagtgttttcattttgaaacattaaaactggtttattgtactattgaaattttattagaatactttcttgtactttcataattaagaaattagggtaatattaagaatttaaacactaaaaccctgatgaaagttatttttctccattaataatatttttatttgtatttcaattagaagtgatctattgtttatattattttctaagaatctaagagtgtgttttttaaacatataacaatagaatccagtaagcattttaattaaggactgcatattatcacttaacctatttagcagattgtagaggcaaaatgcttgcatgcctattttttaaggattctatctttgtaagctatattttaacttttattgattgaaatatagatttttggtcatataatgactgcctacctccaattacag

SEQ ID NO: 47253 - DNA, 311 bp, Homo sapiens
accaccacacctggctaatttttgtatttttagtagagacggggtttcgccatgttggccaggctggtctcaaacccctgacctcagatgatctgcccaccttggcctcccaaagtgctggaattacaggcttgagctgttgactccctcttgagttccttcctgtgtaaagccaagaacccatgtgacctcctgggctgagcctctaattttggggtcgccctgtgacaggattacaggcatgtgctaccacgcctggctaattttttttttttggagggagaggggtctcactatgttgcccaggctgg

SEQ ID NO: 47254 - DNA, 107 bp, Homo sapiens
ctggaatgtgatggagctgtagactgaggatggccgagcaacaagtggggaggaatgtgggaccctggtgaccatgaagccaccctggcagccctgcaggacaaaag

SEQ ID NO: 47255 - DNA, 408 bp, Homo sapiens
ttgagatgaagtctcgctctgtcgcccaggctggagtgcagtggcaccatctcagctcactgcaacctctgcctcccaggttcaagcaattctcctgtctcagcctcccaagtagctgggactacaggtgcacgccaccacgcccggctaatttttatatttttagtagagacgtggtttcaccatattggtcaggctggtctcaaactcctgacctcaagtgatccgcccacctcagcctcccaaagtgctgggactacaggtgtgagccaccacacccagccttaaaatgtgatttttaaatcatgttttcctaaacaaaattataagatgccttgctaacatctaaatcaagaaataccatctccaagaaacacaatcaacaaacaatccccatctttaagagcc

SEQ ID NO: 47256 - DNA, 285 bp, Homo sapiens
gtttccaacagagttagatttggccgtatgtccaagttgtggccaataaaatgcaagaggttgtgcgccatttctaggccccatctgtaaactcacacgctctttgccctccactagctgatgtcagtgcccaaattgaccttggaggtcatgggctgaagatggtggaattgcgaccaccttgggtccctgaatgactgcatggagcaaagtccctgcattgacttggatctacgttgggctgttacacaagtttagaattaaactgtaatgtgtgaagccatt

SEQ ID NO: 47257 - DNA, 1118 bp, Homo sapiens
  misc_feature (763)..(763): n is a, c, g, or t
agaagccagacggagctcggagatgtggagggcagacgcaggcgcatttggaaaagggactggcggtgggaggcgcagagggaaaaaggaacgacacaatcgggcttcctagccgctggcggacccgatggggcgtcctgcgagggttcggcgagggttctgccaggatagtagcattgcgcccaaggagtgagaggcacccggggctactggagccagaccctcaacccgccctagtgggaggcgaagaacaacgaaagcctcgtattcccatttctctaatggctaatgacattaaaggttttcatatggttatttgccatctgcatatcttcagtgaagtgtctgtttatgtcttctgactattttctaattggatttttaaaaataattgatttttgagttatttacatattctagatactggttgtatgccagatatatggcttgtaaatattttctcctaggtaaaccttttcagtatcgttacagggtctttcacaaagcaaaagttttaaatttatggagtctaattcatcaacatttctttttaccggtcttgccactaatgtcaatttaagaaccttttgcctagccttagacaatagtttgttgttttttaaaaccgttttgtaattttactcgtcacagttatatctagccacttaatttttatgtaagggtaatatggaggggggacgtatgatgtctggctttcagatcattgtggagagatatctggcgcattaacgttttggacatngctaaaacaaggccggtgtgtgagaaatactgtgtaatttaaccgaggagaaatcgtataaatatcacatgtatggcgaatggaaagtgcctacgatgaatgtatgcacatgaggcgtcgagagtacacttagaggatgccgcggcaatttaagcgcgttcctcgtctcctctttttttgtgcgactactgcacttcgacggccagagaaacgacaagagagacggatgctaacaaagtatacagatgagtgacagacagcacaggtacacacacgaaggtgagcatgaggcacgaggctgctgagacgacagcaggacacgcggcacacaccacgtgaagcacacccgcgtggg

SEQ ID NO: 47258 - DNA, 328 bp, Homo sapiens
agacagccttggcagacggatggggagtctggcagttacaggggcccttcctttcctaggtgcaaattgcctgtccagcagctttatcttcagatgggctggcactgtcacttcacaccttattgcttctctgttatcaccaaccaaacccccacagaaggggaggccaaaaccatgtgggaacagatgctacatcctaacagcaagcctgttctatatgtgttttgctggactctcctttcaacaccctctcctgccccaggggtgggtttgggggtactatggtgcaaccccagatatggccattcttctaaatatttcaggccag

SEQ ID NO: 47259 - DNA, 1117 bp, Homo sapiens
cgtggtcagtctagctggctaaaggtttgtccattttgatcttttcaaacaatcagcttctggtttcattgacttttcactgctgtttttgtattctctacttcattaatttccattctaatatttagtatttccttgcttctgtcttgctttaggaacagtttactcttctttttccattaccttaaggtggaagattaggctcttgatttgagatatcttttttagtagaggcattttcaggtattaattattttctaagcactgctttaatgtatctggtaaagttttgggatatcttcattttcactcatctcaaagtattatctaatttcccctgtgactcttctttgaccagatacctttgttttaaaaaaagttattacaatataaatatttgaaagtcatactgagggctttaattataggcaattggagaacgggaatccattgaacctgatttacttctttttacatgattctactttatgtgtctctttctgtaccatctaaaccccctaaaaataatcttgaaacctagtgaaggaacttgagtcactagtgacagtcggttgttgggatagcttgtgaaggctggtggatccatttggttgtagctaatggcgtgaaagaattattaaagttttaaggtttttaataggagtttggaagaaaccttagaacctatgaagtctaatcttgacccaaatagctgtttcttctaaatatctcttgtcagatggtcatctggtttacattccatttcttttatataaagattttcactgtgttgcccaggctggtcgtgaactactgggctcctcctgccttggcctcccaaaacttcgatagctcctcctgccttggcctcccaaagtgttggaattacaggaatgagccacagcacctggcctacattccgtttctagtgttaatacttatgtctgcattagaagaaattatagtgagcttgcctaccaaattgttgaagatctgagaaaggcaccaaggcaacaaaattggaatctcagaacatctcagcagtatgcaacagggatagaatataacaggatgaccttttttcttttttataaagaatatttttaaagttgtgaac

SEQ ID NO: 47260 - DNA, 362 bp, Homo sapiens
aaaattgctggccatttgggtcatgtcagacacagagctcacagggctgagtcacctgttttggtgttttgaaaagatttacccctataaacaaatgagaaattaacagaaaccaagaatcacttctagggtgaaaagaatcatgaaagtgctgaattatattcctatgattggtacttggcattagtaatttattaccatcattcagcagccagaggggccctggactgaaatgcaatccatggcccatttttgttcttctttagagtgttctggcccagttctatgtatgctgaccagcacacccataagcttcattggccctttcagtgcaggggccttggctgtggcatctacaaggg

SEQ ID NO: 47261 - DNA, 324 bp, Homo sapiens
ccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttc

SEQ ID NO: 47262 - DNA, 675 bp, Homo sapiens
aaccaatcttggtctagaataagtctcaaaatcaaaagacttgaattctagtgcagcgtaggttgactcccttatttatttaattttcccatctctacaccgctagaataacctctctcctgaggctgttgaatctgatgaattagcagataggaaagaacttagaaaattataagttcactcaaatgtaaaaggttatatgggaaataatcaccactaacatttttgagtacttactatctgcttgttatacacattctctaatttaattttcacaagaaaattcatgaaaggactatacttatcccccttttacaggtgagcaacctggagtgcagtgaagtgtaaaatgtgggccgacttaggagcacaaataccccagcaacaatgagcactcttagtacacaggtcttggtttctaaaatatcatcatccgataaaaggaacacaggctctttgaagaaatgactgattccgggattggggcaagaaacacacaagctgagactggagcatcttgcagtcccagaaagtgaagaaacgctgaggatatgtcaaagggacacaggagccaaatgaaagagcttccactggccaaagctggaatgttgagcaacaaagcaacatagcattggataataacccaaagtataaaataaatattcatgagtacat

SEQ ID NO: 47263 - DNA, 655 bp, Homo sapiens
ctattctctggaacagtcccttgactctttctctcaaagctctttcaattacacatgtgcctttatatatgcatttgtcattgacatttttcattccggcctctctctccatgggaccctcatttgtgctgctctcaccttcaagagcttgcagtcaggagagatgctccataaacctttgtagaatgaatgaatgaatgaactgaccagtctccttctctgtaattcagagacattagactgcaagctggacactgagcagtggaaaaagccaggctggccacccagagctgagctctccccgccccggagctcacttgccaggtgaccttgaacaactccctccctgtctctcagctctggcttcctattatttctttattaaaaccacttgattgagacatgactgctattcataaagttgcacatatttaatgtctataacctgacaagtttggagatgagtctacatctgtcacttatcatcaccgtcagcaccatgaacacgtccgttaccttcaggcatctgccgcctgtattcttcatgcttcggtttcctgatctatgagcaaggacactggcccaaggaagcagtttgctcttttattgctgcatatctggccaaaagccctaccttcagaaaaactaaaaattc

SEQ ID NO: 47264 - DNA, 758 bp, Homo sapiens
gactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctc

SEQ ID NO: 47265 - DNA, 438 bp, Homo sapiens
gcgcagtatttctgtcctcaaagagtttagggtctggtagaagagaaaagtaagtaaatagtaagttacatgctgagacaggaaaaattaaggaagctattggagtgcatataaattcttgatagcaccagttctcaaatatgaggtgttaaaaactggatggaatttaaccctgtccttagccctgttatataacctaggagaaaggctggctgcaactccgggagcatgagtagcccaattcagaattcagggcccaagctccccactgatggaaagatacaaagaaactacttgccagaagccaggaccaatttggcagagtctactcaaaacagtgagttttaggtaagaaagcctcagaacagttttcattagacataccagtgtactaagtccctcaagcagaaaacttagggatatgacagaaaaaaaaaa

SEQ ID NO: 47266 - DNA, 472 bp, Homo sapiens
tgactgcaccttagaatcacctgaggagttttcagcactcccatgacagggggcactccagaccgattgaatcagaatatctgcgggcggatcaggtttctttttttaacactttaggtgattccaaagtgcagccaaggctgtgaatcactgttttacctgcacaatgaggaattggagtcaatcttaatgggaaaaaggcaatatttggagcaagttttgaaaaccaatgttttaaaaaccaatcttaatgggaaaaaggcaatatttggagcaagtttgaaaaccaagatgttttctaggtgagaagaaggagtggcaagagataaggcaggaacatttgcagtgatttaatgaagctggtggattcaaagaaagaaatggattcaagaaatacttaggaggtaacactgattaagactttgtgccaaatgtgaggctaaccaagaaggaggaacctcagataactccc

SEQ ID NO: 47267 - DNA, 314 bp, Homo sapiens
ttcactaggcattggaaaataaaggctaattggacattgtcttagttcttgtggcactcaagatccagtaggaaaaaaaaaaaaagaaactttatcaatttaggctggatcattcctatgatcccttccaacactgattctatgatgttctgtctcaaagaagcaagttggaagccgggcttacaaaatatctagtcctttgacatctctgatatctctagaaggactgaactttcatctgatattcaagatcttgaaagagcaatttaagggaaaaaaaagcttcttcccagaatgtattataaatctattag

SEQ ID NO: 47268 - DNA, 438 bp, Homo sapiens
agtgggctagggaacaagggttttaaccaccgattaagtgtatggatggaactggtagaatggaagttcattccttttctatacattaaggtagatcagtcattccttgttattttataccttttggtttaatatagataatgtacagtaatttgagtttatagccttctggtagtaaaagtttatttaaaaacagtattaaaaggttgataaagatataactaacaaataattttccataataccatttttctcagtgtttttttaaaagcaattacccataagagaagctgaaaaaaggcatttctagaatgtggaagcatctttagagattatgacgaaaagttagatagctatagcttttatagaatttcaataacaagcacagtaatagatctcttatagttctttcttctttcctttttcaataaaaaaaaa

SEQ ID NO: 47269 - DNA, 426 bp, Homo sapiens
tattccaaactttgtactcgaggggagtggaaagcttgaagacctggcaaaggatttatctatttagcattctctttgtcattggtggtgccctaggtttgaggtttgtgagatctgaaagtaacattccaatgaagaactaaagcacatctctgccacacagaaggtgaggtttgtggcaatcaatggaactaacaaatccattctgttttttattatgactaaacctaagttgagggtgtgggtattagagcagctgaaattcagttgcctctttgggggtaagctgtacacatcactcaagaaacagctggatgcaagctaaaacctgctctcattctccctcttgcctgctagtgtgttagatccatggaagacagtttctctcagcctcacctcttgcatttgactgttgctttctaccta

SEQ ID NO: 47270 - DNA, 238 bp, Homo sapiens
ctcttgtctctaaatccccttgtgtctaaggctagcattattattttttctattaatactactctccaaattaattatcgtatctctgaatcatttcctacatatggtaccaactagtagcccctccttcttaatcctcacctctattagcttctataatattcaactttttcttcttgaaatactgatgaataccagcgacagtgtaagttatgtaaaacaaagaatagagggcctt

SEQ ID NO: 47271 - DNA, 649 bp, Homo sapiens
cccagcctgctggccctggggcgcggggcgtcgtgggggtcgttgtcgttgagggtcgttgccgtgtgtggcgtcttagcctggcccctgggttgtgccccacggacgcagtcgacccctctgagcgcctcgggagccccgaatagcagctgggagaaggggcgaggactgagcctcgctgcccgctgccggccgggctagagatacgggcgtgccccccattgtgcgcctcccgccctccggtcccctcaccctgcggccacctggggcgtggggcggtgctcctgcccgtgcacgtagccgctgcgagcggaggcctgctcacctggtgcctgctactcactcccccgggccggtgggcgaaggacacccgcaggaactcggcagaggagaaattcagacggctcccgagggtaggaaaagaccccggcccaccgtggaatctgaaacacccgaccactctgccatcccatgtttcaccagtcagacccccagggcagggcaggggaagcagaatgcaaactggggcaccgtttccctgaagcgtgttggccgcgtttgtcgtagtgctagaggtgcatacccttggaccccgaaaacccattcctgggaatttgctccaaggaagtaaagatgttacaaagatgga

SEQ ID NO: 47272 - DNA, 1120 bp, Homo sapiens
cccagcctgctggccctggggcgcggggcgtcgtgggggtcgttgtcgttgagggtcgttgccgtgtgtggcgtcttagcctggcccctgggttgtgccccacggacgcagtcgacccctctgagcgcctcgggagccccgaatagcagctgggagaaggggcgaggactgagcctcgctgcccgctgccggccgggctagagatacgggcgtgccccccattgtgcgcctcccgccctccggtcccctcaccctgcggccacctggggcgtggggcggtgctcctgcccgtgcacgtagccgctgcgagcggaggcctgctcacctggtgcctgctactcactcccccgggccggtgggcgaaggacacccgcaggaactcggcagaggagaaattcagacggctcccgagggtaggaaaagaccccggcccaccgtggaatctgaaacacccgaccactctgccatcccatgtttcaccagtcagacccccagggcagggcaggggaagcagaatgcaaactggggcaccgtttccctgaagcgtgttggccgcgtttgtcgtagtgctagaggtgcatacccttggaccccgaaaacccattcctgggaatttgctccaaggaagtaaagatgttacaaagatggacccacgaagtatggtcgttggttatgggtggggtcttgaggaaggccttgttagtagcctgaaccctgttgccaggagaagctccaaaccggtagacggagggagcagcgcggcctatgttggggtcttctctgggcgggggacatgatcctaggatgtagaactagcctcagaaaacttaagactcagtggccaggtgcggtggctcaggcctgtaatcccagcgctttgggcggaggtgggtggatcacctgaggtcaggagttcgagacccgtctggccaacatggtgaaaccccatctctactaaaaatacaaaaaattagctgggcgtggtggcaggcgcctgtagtcccagctactcggaaggctgaggcaggagaatggcgtgaacccgggaggcggagcttgtagtgagctgagatcccgccactgcactccagcctgggcgacagagcaagactgcgtctca

SEQ ID NO: 47273 - DNA, 517 bp, Homo sapiens
aaatgtgccagagtgagcacatgctgttggaaaaatggtgctgaaacacttgctccactcagagttgccaaaaacctttaatttctttaaaaaaaaaacctgcaatatctgtgaggcataataaagtcaagtccaataaagcaaggtatgcttgattttataaaacttatgttttgaaaaagtagatcacatgcccaagttgtttcaaacatactcaaaagtatttctcacaaggcatggtggctcacacctgtaatcccagcactttgggaggctgaagcaggaagatcgcttgagtccaggacttcatgaccagcctgggcaacaaagggagaccccatctttacagaaagtcaaaaaattagctaggcatggtggtgcgcacctgtagtcccagctactcaggacgctgtggtgggaatatcatgtcacttgagccctggaggttggggctgcagtgagccatgatcatgccactgcactccagcctaggcgaaaaagcaagaccctatgtcaa

SEQ ID NO: 47274 - DNA, 761 bp, Homo sapiens
gaggttaagaacaggggatctaaggtcacacagccagggtttaattccaccattgctgcttaagagctgcatgatgtgggaaaaggtacttgacctcctgaacctcagtttcctcaactgtaaagtgggttttctaacctcctaaccttccgaggtggtcatgaggatgaaacaagagtgtgtctaaagccctgtgcctgagccctgggatgtagaagtactcagtgaagcagagtggaaatcttatcatgagcactgttaatccatgaaagttagggattgttcctgatgctagagttgtaatgatagtaagtgctggttggatcagagcaagagtgggtaagctatggcccacaggctaaatccagcccacatcagtttttttgtaagtaagcttttattggaacacagccacatgcattcatttatgtattgtccataactgctttagtgctaccactgcagagttaagaagtagcacagatgtcccacagcccacagaatcaggaatattttactctctggccctttctctgacccctgtgatggagggaggcaggtgaagggctcataatgcacacttgaggatgggcggcagaaaagacttccagctgggtgcagtggctcacgtctatagtcccaggactttggaaggcagaggtgagaggatcacttgaggccaggggttggagtgcagtgagctatgattgcaccattgcactccagcctggactaaagaatgagaccttgtcacgaaaaat

SEQ ID NO: 47275 - DNA, 391 bp, Homo sapiens
aggcacgtactataattagttgtgtagagttaagtctgcatatctggactaaatccaagcctccattatgtactatatatgtactgtatgatgatgtgactggatgaggatgttctttgactgttagaggttatctattttgaatcttagacatttgccacagtatgtaagaatgtacagaggtttgggaactggcattcttttgataccagaataattaattcttgaggataccatgtgatcattaaaacctctgagctcctgggttggtgctcatcttctagcagtcaaaccagattgccgcttaggattctcaacttggatataaactaaatctcaagggtgttggttccaaacattggatttggattgaaatgagtgtctcatgcat

SEQ ID NO: 47276 - DNA, 353 bp, Homo sapiens
  misc_feature (172)..(172): n is a, c, g, or t
gcagaccgatcctcaatctgggtgggcaccatccaaccggctgccagtagggctagaaaatgtacgtggaaaagtggaaaaaggtggaataagcagacttgctgtgtcttccggccttcatcatactcccatactggatgcttcctgcccttgaacattagactccaatttntctggcttttggacccttggacttacaccagtggtttgccaggggctctcgggcctttgggcacagactgcagaaagtatgatataattatagccaagaaaggtgagctctaatcagtatgttgtttcaggcctaaagaaaagctatgcaacagagtagtatactatagcaccttgaaaaa

SEQ ID NO: 47277 - DNA, 115 bp, Homo sapiens
aatcaaggatatcaccagtttatctgtggccaaatagcaagccacataatagtggctctgttgtagtaaaaagggtaaataattgttatttggcttaacctaaatgtgacaaaaa

SEQ ID NO: 47278 - DNA, 384 bp, Homo sapiens
cagtattttccaaagttctctgaccatagaacccctttctgtacactgttaattattacctttagctctataagcgcacactttaggaaatttcattctaggcaattcaaggaaatagaagtttttccaatcaagttatccatctaattactcaagtctgccaaataaactttgaaaaggcataaagatcttataaatttaaaatattatccttatcactgtcttaaaatgtttcatcctgctaaaaattgtgtaatataagacatttaaatataaaattggatgaaattctggcaggtactagaattgagcagattgctacactttgatagtatatatggtttaataacaaattaacgagaaatgtttagctacatttctttc

SEQ ID NO: 47279 - DNA, 411 bp, Homo sapiens
aatcctcgaaacgccaaagcacatgttccatcctgtacctccatagaaagagatcttcgaatcaatgtcatgatcctcataattttgtactcttagtctcggcacgaccgactccttcaggtctcaccgagagcccatgtgttcttgatttacacacaaattgaatagtcttagttgtctggttttcaaacccttcacagataaagagaaacaagttagaaggagcaaagaagcaactgctggtggcaacactgacaaacagaaatgacagctgctcagggtagacctgaaattaagggatgggccagcaaaatttaataagtaaatataaggacccagttcttacagtaactgactcatatataatgactcagacaagaccgagactcctacctcaatcgaccctcttgg

SEQ ID NO: 47280 - DNA, 481 bp, Homo sapiens
cccatcacctcgccaacaccctatcatctccccctgcagataaggggaccatagcaggagagggcggcctggctgggggcactcgagtggggaccagagtgacccgacaggaggtttgggccagatcagggcagcacaaggggaagatgaccctcataggggcactgagaggacacagtgtcgaagaaaagcacaggcgcctgccagaggtgtgacccgacagcaaaagtgtttcaggggaagaaaaaccaaatgtggatggtgtggagttccaattccagccttgccactggctaagtaaccggtgtgaacccaaaagtatctgagacaggtctcagtccatttagaacatttattttgcccaggtgaaggatgcactcctgacacagcccgagggggtcctaactacacgtgcctgcggtggtcagggcacagcctgcttgtacacatttcagggagacagaagacgtcactcaataca

SEQ ID NO: 47281 - DNA, 170 bp, Homo sapiens
tatccattgtagacacctttaatgtggaaactcatgtccttcacttcttaacatttccagaattatttcaacgaatatatcctctcttctattttttttttctcctttctgtctagaactactaaaaagaaaagttttaaattgggtcttatggactagttctttaatat

SEQ ID NO: 47282 - DNA, 311 bp, Homo sapiens
agctccaaatcctaggcatttgcccattgacctttaaaagcctggaggcagggcctatacagccctcctctggcctcctctgagatgccaggcttaaagtcttacaagtagcaaatcctcaacaagtatttgttaaatgaatgctttaagcaatctgtggctgggtgcagtggctcacacctttaatcccaacactttggaaggcagaggtgggaggatcgcttgaggccaggagttcaaggctacagtgagcaatgatggcaccactacactgcagcctgggtgacagaacaagaccctgtctcaataaa

SEQ ID NO: 47283 - DNA, 371 bp, Homo sapiens
tagtagagacagggttttgccatgttggccaggctggtctcaaactcctgacttcaggtgatccacccgccttgacctctcaaagtgttgggattacaggcatgagccaccgcacccagccaggtctgttaaatttaaagcccatgatgttagcccggatcagtcctgtttctcaaggtctctcctacctgagatgtgctaaggaggagaagggggtctctctcttaatggggcagtacatgtgcattgctctcatcactgccttggtccttagctctccgctcaaaggagggctggcctatggatgagacctgggtttcattctctgaagtctcctgcatcaaatcaatgtccaatgccatgattattct

SEQ ID NO: 47284 - DNA, 475 bp, Homo sapiens
cacccctcatgccaccaaggggtgcagtggcctgtttttgccagggagctgtaccatccatatgacaataatacaagtcaacaggatgctacagaatttgacttttggtaaattttgctgcaatgcacttagctacaaagaagggcagtccatctaccaaaatgcttttgaagtgttcaggaaatgactcactgtaaagtttaggctttgaaaacacctctgtgggacaaggccgacaagtgtgtaggtgttaaaagaaacactaatttattgactagaaaatgggcaatagggtatgtgaggataaactgtcagaggctgggggttaatgaccttttctcttcttgcatgtggagaaataagcacttggaacagaaaggagctctacccaactacccggaatgcaggcgggcctgggactatgtgactaccaccctctaagtgaggttttgaaaataaacacttgaaagtctga

SEQ ID NO: 47285 - DNA, 382 bp, Homo sapiens
aaatggccaatttctttcaaatgctgtatactggaaaaatccaaaggactcatcagatgaacacatttcaaagagccactaccaattttttttcttaagcaaagcatcaagcctctgatttgccgctgataaattctctgtgtcagacactgctccaggccaggaacacaagaaggaaagtagacccaaccatggaggagttggctgtctcctgggaggcagatgtgtagacaaggcacactggcattgacgccacaacagaaaaataagcacttggaacagaaaggagctctacccaactacccggaatgcaggcgggcctgggactatgtgactaccaccctctaagtgaggttttgaaaataaacacttgaaagtctga

SEQ ID NO: 47286 - DNA, 289 bp, Homo sapiens
ttccagcgaaaatcacctttcaagaaaaattttttagcaaacaaaaacagtttgtcaccagaggacagcaggaacacaaaagaatgagcaaattatgtcataaatacgtggttacatctaaaggaaaattaaattaagcaaaaatagtgttgcatctaaaaatacagaattaggccgtgagccactgcgcctggttcgtttattgagtgaaggttattcattgttaataactgaaagaaagtagaaaatacacctaatcagttgcttattctaatgtagcagatgaccg

SEQ ID NO: 47287 - DNA, 1528 bp, Homo sapiens
  misc_feature (1507)..(1507): n is a, c, g, or t
ttccagcgaaaatcacctttcaagaaaaattttttagcaaacaaaaacagtttgtcaccagaggacagcaggaacacaaaagaatgagcaaattatgtcataaatacgtggttacatctaaaggaaaattaaattaagcaaaaatagtgttgcatctaaaaatacagaattaggccgggtgcggtggctcacgcctgtaatctcagcactttgggaggctgaagcgggcggatcacctgaggtcaggagctcgagaccagcctgcccaatgtggtgaaaccccgtctctactaaaaatacaaaaattacccgggtgtggtggcaggcgcctgtcatcccagctactcgggaggcagaggcaggagaattactcgcacccaggagctggagatttcagtgagccaggatgtgccactgcactccagccggggcaacagagcgagactccttccccccaccaaagaaaaaaaaaacttaaaaactcgtacctagttgcattccttatgagcacagagcaaaatgtcctcattttacctggtttaattttttttttcttccacggcctcttttactgggagacctctgagttttgatgtgtcatgacagataggagaggtcatatccttgtgatttgtggttcattgctggtgacatcagaaagtaaagtcaaccaggaaaagactccatgggcctggctcaggtggcttctggagcaccacctccatcaaggagcttttcctggggtccatgtgtagtccatgttgcctgctctcccacccagggttgctgtgcttattatacaagatggccaataaagcatgacatatattcaataaatgttcatttctttttccaacccttcttattttaagttgagggtattcataaaagggattgagcatttccatttatggacgaggcaactgagtacagcccccaggggcacgcagcgagatggctgtctgctgaacccatacaccagctctctaggcgtttggtcctgtggggaccggtgcatcagatgcttcctaagctggcgtcacctgcctggcccgatgcctcctctggtgttcattgtttaattaatgccacctcctgatggcagtttctttctgggaagaggagaaaagagagccgtccccaagtgaagggtgcagggaagcctccacgaatagtttcaactaaggactgtcccaggaaggaaactcttgggataggcaaagaacagcgaacttccggtgtgacccggatgcacccatttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagtgtctgtcccccatttcttacacacattgagtgtgattgttaccagtggagggtgtccaatggaagaagcacacgccgcccaaaagaaggatctttaccatcngaagacagcatggggatctta

SEQ ID NO: 47288 - DNA, 1421 bp, Homo sapiens
  misc_feature (24)..(24): n is a, c, g, or t
  misc_feature (1400)..(1400): n is a, c, g, or t
tttgagacagagtcttgctctatngcccaggctagagtgcaatggcacgatctcggctcactgcaacctctgcctcccaggttcaagcaattctcctgcctcagcctcccaagtagttcggattacaggtgcctgccaccaaacccagctaatttttgtattttttttagagatggggtttcgtcatgttggtcaggctgatcttgaactctgacgtcaggtgatcaagaccagctactcgggaggcagaggcaggagaattactcgcacccaggagctggagatttcagtgagccaggatgtgccactgcactccagccggggcaacagagcgagactccttccccccaccaaagaaaaaaaaaacttaaaaactcgtacctagttgcattccttatgagcacagagcaaaatgtcctcattttacctggtttaattttttttttcttccacggcctcttttactgggagacctctgagttttgatgtgtcatgacagataggagaggtcatatccttgtgatttgtggttcattgctggtgacatcagaaagtaaagtcaaccaggaaaagactccatgggcctggctcaggtggcttctggagcaccacctccatcaaggagcttttcctggggtccatgtgtagtccatgttgcctgctctcccacccagggttgctgtgcttattatacaagatggccaataaagcatgacatatattcaataaatgttcatttctttttccaacccttcttattttaagttgagggtattcataaaagggattgagcatttccatttatggacgaggcaactgagtacagcccccaggggcacgcagcgagatggctgtctgctgaacccatacaccagctctctaggcgtttggtcctgtggggaccggtgcatcagatgcttcctaagctggcgtcacctgcctggcccgatgcctcctctggtgttcattgtttaattaatgccacctcctgatggcagtttctttctgggaagaggagaaaagagagccgtccccaagtgaagggtgcagggaagcctccacgaatagtttcaactaaggactgtcccaggaaggaaactcttgggataggcaaagaacagcgaacttccggtgtgacccggatgcacccatttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagtgtctgtcccccatttcttacacacattgagtgtgattgttaccagtggagggtgtccaatggaagaagcacacgccgcccaaaagaaggatctttaccatcngaagacagcatggggatctta

SEQ ID NO: 47289 - DNA, 510 bp, Homo sapiens
ctaggcgtttggtcctgtggggaccggtgcatcagatgcttcctaagctggcgtcacctgcctggcccgatgcctcctctggtgttcattgtttaattaatgccacctcctgatggcagtttctttctgggaagaggagaaaagagagccgtccccaagtgaagggtgcagggaagcctccacgaatagtttcaactaaggactgtcccaggaaggaaactcttgggataggcaaagaacagcgaacttccggtgtgacccggatgcacccatttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagtgtctgtcccccatttcttacacacattgagtgtgattgttaccagtggagggtgtccaatggaagaagcaccaaaagccgagatttattga

SEQ ID NO: 47290 - DNA, 320 bp, Homo sapiens
agtatctgtcttcccagctcctgtttactcttgttgatgccacatattgcataggactgtcaagactaatgtctgtgggtgacaaatagaacctggaactgaaaatgtaaatttgagaataacagttcatgaccaagaatccaaaagcaaatgcaacaaaaacaaagataaatagatgggacttagttaaaccaaaaactttcttcacagcaaaagaaataatcagcaaacagacaacccacagagtggaagaaaatatttgcaaactatgcatttgacaaaggactaatatccagaatcgacaactcaaacaaatcagc

SEQ ID NO: 47291 - DNA, 1353 bp, Homo sapiens
ctctggggatgtcggtcagcttttttgaaatgatcttggtgctagaaagacttgtaactgtttaagggtctctcttccactaatcttatcctcctaaacttctgccatacttgtgacatgtgaaatgcaggggtgttctgagtaggtttctgccttctcagcatagtgcttggcactttgtaggcccccaggcccccagtaaataattattgcaagaatgaatctcagctcggtgcagtggctcacacctataatcccagcactttgggatgccaaggtgggcagattgcttgagtccaggtgtttgggtccagcctgggcaacatggcgaaatcccatctgtacaagaaatgcaaatattagccagacatggtggcacatgcctatagtgccagctactaggggtgactgaggtgggaggatcacttgagtgtgggagctgtgatcgtgccactgcattctagcgtgggtgacagaacaagaccctctctcaaaaaaagaataaatttcaatttatgtccctggaggactggcttgaagatgttaaagaaaactctaagggccccctttacacctcttgtttaaagccagaatccacttaactagcgctagacccttgcggggtgccctacctgcatctcccctaattatatagccaatacaaagaattaacctcccatagctcactgaaagaagagaaaataacaaataatatcgtataaagaggcatttctgaggtaatagatgttatttaattataaattgagtattagatgataacgaaattttgtgagcagttaaacaatggcagtgtggttctgtagagctatgtctgcatattgagctgaaccgtaagagtgaaatggggtgacgccaaggattgtctttaagataccaatgggaatggtagagaaagaacctatgaaaagccactctttaagaacaatgagaacaacaaatatgtcaaaatgaactccagaattcaggaaattaaccaaaggcaatgtgggaagttttactcaagaaaaccacctgaatctcagcaagaacagcctgctttgtagcatttccactaaccctaatttcatctcatctcccaaactttgtgttagccttgacaaccaacagtgccacaatcccagggaaaaccagcagccactggagggtgtagaaggggctctgaagctccctcaaaacaccatctgctgagaattgttatttgacctgacagttctgtgtggcatttttctggaaaccccccttcacaatgttgcagaattttgctccttcagctaaaattgggatcttgtcacacaaccaggaaaatttgggcatgcagacacattgaagggt

SEQ ID NO: 47292 - DNA, 344 bp, Homo sapiens
gtggcttatgtacagccttttagactatgaggcatgaatagcaaacagtggcaatcgatgctgaaaaaccagaatgtttaaaaactgggccataaaaatgtagaacgtattctgtcaccagagctggggtcagtggggtgaccccctccctgcctccctgccccccagttctccccagaccttcctgcctgcctgtttcctgcctccaggacagtgtgcaccctgtgtccgtcttctgccgctacacctgtgaactggcaccacaggtgggaacagcccttcaggccagattctggtttttggtttttgctttactgccaaatatgatctagtgctacattcaa

SEQ ID NO: 47293 - DNA, 338 bp, Homo sapiens
cgaatttagatggaaattctttggcctgaaatgtttgaagctttatcctcaggtagtaaggaaccactgaagagtttgaagcagtgaaatctgtcagatttgtacttttaaaaatctcacatcaaagcctggcctggtggctcacacctgtaatcccagtactttgggaggccgaggcaggaggattgcttgagcccaggagtttgacaccagcctgggcaacgaagcaagaccccacctctacaaaaaataaacaaatataaaaataaaaattaggtgggcatggtggcatgcacctgtagtcccagctactcaggaggctgaggtgggaggatcac

SEQ ID NO: 47294 - DNA, 866 bp, Homo sapiens
tttttagagataaggtcttgctatatatatggcccaggctggtcttgacccagcatcaagtcgtcctcctgccttgcgctcccaaagcactgggattacaggtgtgagccaccatgcccagccagatctttcttgtttttgatgtaggtgtttattactaaatacttccctcttaaaactgctcttgctgcatcccatacatttttatatgttgtgtttctgttttcactcattttaagacatttaaattttgtttcttaatttcttcattacccattggtcattcagaatcatgttatttaatttccatttatttgtgctgctttaaaagttcctcttgttattgatttctaggtttatttcattgtggtcagaaaggtacttgatgtgattttaattcttttaatttttgtgatttgttttgtggtttaacatgtggcctctccttgaaaatattgcatgtgcttatgaaaaaaaatatgtattctgtagctgttggatgaaaagatctgttagtgtcttttaagtccatttggtctaaagtcagtttaaacttggtgtttctttgttgattttctatgtatatgatctgtccattgctgaaagtagggtgttgaagtccacaagtattattgtattattgtattgtcttcccctttagatctaataatatttgccttacatatctgggtgctctgatattgggtgcatatatatttacaatttttgtatcctcttcctgatttcatccctactgtgtttgatacaaagtctcttatcgtaagtatagctactccttatatagtcatgattggtggtaaaaacaaaacaaaaagaaaagaaaaaagaaaaaaaatgtatagcta

SEQ ID NO: 47295 - DNA, 272 bp, Homo sapiens
ggaaaatgccaacagggattgtctgtgggtggcttttttctcttctgtgtctcagatgttctttaagaagcatgtgttacgtttacggtaggaaacctcccagtttttaaataagaagtgaaaagcctctgtagtctgaggtgaagcaaatgcctgtgatacgatgttgcagcgtttcctttaaccgagcctgtttgctcttctgtgagatacagatagtaagggctggctgcctcatggggctgatgtgacgattaaagagagctgtgaca

SEQ ID NO: 47296 - DNA, 409 bp, Homo sapiens
  misc_feature (10)..(10): n is a, c, g, or t
cccaaaaaantgggcacgaagcctgcccctgacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaataact

SEQ ID NO: 47297 - DNA, 400 bp, Homo sapiens
  misc_feature (35)..(35): n is a, c, g, or t
  misc_feature (45)..(45): n is a, c, g, or t
  misc_feature (55)..(55): n is a, c, g, or t
  misc_feature (81)..(81): n is a, c, g, or t
cgtgcgccaatccacaagaaagaaaagaagcctcnttgtaaaccncgggcttgtncctggctgcaaatagaacccccaacngctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaataact

SEQ ID NO: 47298 - DNA, 401 bp, Homo sapiens
  misc_feature (31)..(31): n is a, c, g, or t
taaaagataagccattaagtgggagcaaacnccaaaaaaactgaggactacagcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaataact

SEQ ID NO: 47299 - DNA, 425 bp, Homo sapiens
  misc_feature (106)..(106): n is a, c, g, or t
aatgcggatctctattaaccgtcggactcattctaaatgagaagaggaatgagaaaaagctagagcactacccagctctgtcttgtgttccaaatggaccccaacngctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaataact

SEQ ID NO: 47300 - DNA, 471 bp, Homo sapiens
cctgtaatctcagctatttgggaggccgaggcaggagaatcacttgaacccaggaggcagaggttgcagtgagtcgagatcgtgccactgcactccagcctgggtgacagagcaagactttgtctcaaaaataataatagtaaaatgttacatgtgcatgaagttttaaattactcatttttattaatgaagaaaataaggtagtttagacattccaagagttaactatagtttacaaaaatatattaagcaaaaatatgcttgatatattaagcagaaatgttgtatattaagcaaaaatgtaaaattcagcaattataaactgttccttacagacagtgtacttgaagtcttttggtagttctgagaatgtggtcattgaagttggatctaagaggaaagtggttatcggttgctttttatttataaaggatgcaaaaataaaattagatttttggcagtcaaaaatga

SEQ ID NO: 47301 - DNA, 478 bp, Homo sapiens
cacctgttgctggaggaagaagcattaacaacatatggggtgctgtgctgcggtaacagaatcaagagcaggtgccactgaacttggtatcttgggaatggagggcactattgacagagcaagactttgtctcaaaaataataatagtaaaatgttacatgtgcatgaagttttaaattactcatttttattaatgaagaaaataaggtagtttagacattccaagagttaactatagtttacaaaaatatattaagcaaaaatatgcttgatatattaagcagaaatgttgtatattaagcaaaaatgtaaaattcagcaattataaactgttccttacagacagtgtacttgaagtcttttggtagttctgagaatgtggtcattgaagttggatctaagaggaaagtggttatcggttgctttttatttataaaggatgcaaaaataaaattagatttttggcagtcaaaaatga

SEQ ID NO: 47302 - DNA, 363 bp, Homo sapiens
cctgtaatctcagctatttgggaggccgaggcaggagaatcacttgaacccaggaggcagaggttgcagtgagtcgagatcgtgccactgcactccagcctgggtgacagagcaagactttgtctcaaaaataataatagtaaaatgttacatgtgcatgaagttttaaattactcatttttattaatgaagaaaataaggtagtttagacattccaagagttaactatagtttacaaaaatatattaagcaaaaatatgcttgatatattaagcagaaatgttgtatattaagcaaaaatgtaaaattcagcctgggtgacagagcaagactttgtctcaaaaataataatagtaaatgtta

SEQ ID NO: 47303 - DNA, 742 bp, Homo sapiens
gaatttagaatacatggtagaggaaagacaggatgagaaccagctgtgactccaataccaactgtagtgacagggactgtagttagtcctactaacctacctcttctaagtttcccttcaggaagagagacccatgggaaccatggaggagttccctgaatgtgtatggggaaatcgatctgtgcagtgcagggggtgacccgtggtagccatggaggtgtcccactcagatctccctacagcagacctgccacaaggggtggagttagcggacagctgtcaagatctgcctcagctttcaagctgaggctacatgcttcccagacagcctctaagcaaaggccaggcactgccatggtacaagggctcaccatttctggccagtatgggactcttcgggagggcaatctttgcaccagcactccctgttttgcaggcctaggctttctcagagctgcactgcagtccaaggctcctcctacccaaatatctttcctggcccctctcctttctcaggttttagtcctacatcacgaactaaaggtgttccttgtctggtcctgttccctctcccttttatgttttataggcgttgcccctaataaaccttttgtatatctgactctgtacccctatattattgaaagagacagatttattgaaggtgataccctgaaatgaagatgtcctgttcttacagatgccctctgatcctatgttaataatagtattatatgtttta

SEQ ID NO: 47304 - DNA, 464 bp, Homo sapiens
gcatctagacctaaataccctgtcaatcctttaacgaggaaagaaggctgttaggaacgcagaacatatagaagaaaatcacataaggactcttaactgatacatatatcattttggaaacaagtctttaggaatcaggattgttggagctaaaaataaaatgtttattaacaggccgggcgtggcagctcatgcctgtaatcccagcacgttcagaggccgagatgggcagatcacctgaggtcaggagttcgagaccagcctggtcaacatggtgaaaccctgtctctactaaaaatacaaaaatagctgggcatggtggtacatgcctgtggtcccagctactggggaggctgaggcaggagaatcacttgaatccaggagatggaggttgcagtgagccaagatcacaccattgcactccagcctgggcgagaagagcaaaactctgtctcaaaaaaaaa

SEQ ID NO: 47305 - DNA, 549 bp, Homo sapiens
tgagacaaagtctcactttgttgtccaggctggagtgcagtagtgctatctcggctcactgcaacctctgcctcccaggttcaagcaatttcccagcctcagcctcctgagtagctgggactacaggcgcccaccaccatgccaggctaatttttgtattttttagtagagacggggtttcaccatgttggccaggctggtctcgacctcctgacctcgtgattcacccatctcggcctcccaaagtgctgggattacaggcgtgagccaccgtgcccagcctccacacaatccatattccctttctgttagcagctttgtcttgtacccatggccgtcacaggtccatggctgatttgccaagttaacaggagtccatccataataatcagcactgggtcatgccccagaatcattaggatcaaaggatgggaaatcagggatttctttgaaagtaagccactcttagtaagattcaaatttgtttaaagcctggattaaaacaatgccaaacaataaacttaaacagactgctttaccctctgactt

SEQ ID NO: 47306 - DNA, 1671 bp, Homo sapiens
gattttaaggtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaag

SEQ ID NO: 47307 - DNA, 563 bp, Homo sapiens
  misc_feature (563)..(563): n is a, c, g, or t
gattttaaggtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacatttcatggcgggccgtgtatcctctagan

SEQ ID NO: 47308 - DNA, 945 bp, Homo sapiens
aaccccaccactccctccgctttgggtgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagcgtatgccgactcgacagtttctagtcaagaatgagacggaatgtgggagagggatattaaaagccctaatcccctcttctgatgttcgaagaaaggcaagaccagattcttgggagatccagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtgg

SEQ ID NO: 47309 - DNA, 460 bp, Homo sapiens
gataatttctaagccttctccctgtacctcgttacagaaaaaaaaaaaattcttctcttcccagttcatctgcatcttgttattgggccataagaacaagcagcgcaaccctcggtttggtccaggaacaggattacaggcataagccaccgcgtccagccaggagccctaaatttttaaacagccctgactactgtcctggttctacctgtgagttgctcactcttccccaccaacagaggatgggaatgaagctgccgggttctgccctcccaagtcatgcctccctccatgctgagtttgtatccaagtcacgttcccgactctgaccggaggcagaaagccaacactctctacctgctggttcccatccggcaaacgatgcatcagcaagaaggcaaaatacccagagaaaattttgagtcacgatgccaaaggggcctctgggcagaaaaaccag

SEQ ID NO: 47310 - DNA, 360 bp, Homo sapiens
tgctggttctaacatttctactttaaagaaagatggctttgacaaactgtaaaagccaaataataatagcaaccccaatatctgtggctctcccttgtgaaccacattacatactgtaaaatcctcccacatttatttggttttcccaacactgtgaggatgaaaagacaagcatactttctccatattcagttaaagaatgtgaggttcttgagttaatttttttatacagtgtaaggaaggaacccagtttcaaatttctacatatggctagtcagttttcccagcaccatttattaaatagcgaatactttccccattgcttgtttttgtcaggtttgtcaaagatcagatggttgt

SEQ ID NO: 47311 - DNA, 2338 bp, Homo sapiens
ggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgttcttcctaacttgtaaaatttcacataaatatattttcaattgtgtacaaattaagggtgtacaaattataataatgcatctctatcttcatactttgaatggcaaacgctatttatgcataaatattttcattttaagtaatatatgaagtgtaaatactcgatatataagtatagattttaaagatatgggactttattttcacataagtcaatagatgtttctctagaacaaaatatttagtaaagctttataaattatattaaaaggaagcggggaacatgtattttttaacatagaacagaagtgacttcattctttttagacatcagaaatgttaaagttgattcccaatatttgttgtacttttttgtagcaaatgttaaaaatcacgagttaccatgtatagaatgtggactgtcatgttgatatcattgtacagtgataagccatttttatctgtatacatttcaccaatttattaacaggttgaatatttgtttctttttagaacattttatttatactgtgaagactttgttataccttatttgctacaacatagatcatatcattgctactttgacttagcatttgcatcataaacataattatgatgtttttttcatgctcccttccaggggctcagtcacttgaagaaactgttgctaaccaagctcttgactctgtttcccttaatgatacaagtctctgtaccagcgctttatgttaattaccaaaactctcctgcatcagagcatgatatctataataggagatactgcaataaaatgattaggctgtaaaatttggagacacaatttttcattacaatgcaatttgcatgtgcacatgtgcgcacataacttatatgttagttcttttttccaaactcccaactcttaaaagtattgtagtctgttggtgcctcaactgttggtaactttttttttaaattacaactttccacaacttgtttttgtactttaaggtttctcaattagaatatttctagttgagctgtaatttgaatgcattgttctcagggctatttgtgctaaaagc

SEQ ID NO: 47312 - DNA, 733 bp, Homo sapiens
  misc_feature (646)..(646): n is a, c, g, or t
caaagccagcagaggtaccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccaggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaacacaacacaaacacanacacaacaaaaatttttggggggttgggcttaaaaaaattttttaaaccattcgttggggggggggggcccttggtaggacactggg

SEQ ID NO: 47313 - DNA, 402 bp, Homo sapiens
agcagctctgcctttactgaaatttcagctggagaaaggtccacaggtgaggtttcttccaaggagtaatttctcttatttgactcttttgagatccttttctcacataattgtcaaatttcaattggagagaaactgtgttttctacctcattacggggtcagtgctgaggagagtaggaactcaggaaatgcttcttgattgactttagtctgctgtattgggtgacaaattgaccacagaccaaataacacgttggaatcctcttattctttctagagatctgggctgagaattaagggtttatgcttcttcttaaaacccgtttcaatctttcatgcagttatgattctcatacaaacaaatggaaatggggaattagtctttcaaattcagtccttt

SEQ ID NO: 47314 - DNA, 1175 bp, Homo sapiens
atcaatggaaatgagaaagcctcctcgaagttaatcccatttttgaagaataaatagatattggactggtgttctgggttggtagccacttgtataaagaccccaagatgttggaagaactcaaagctgacaagtattgctagaatttagaaagttatgagccagagatctctaagggcaataggaatccattaaaagttttaacactggtgtggtgttaatcagattggcattaaaacacacacacatgccgggcacagtggctcacgcctgtaatcccaacactttgggaggccaaggcaggcggacctcttgagctcagaagttcaagaccagcctggaaaacatagtgagaccccatgtctacaaatacaaaaaaattggtctggcacagtggcacacacctgtagtcccaggacttgggagtctgaggagaaaggatcacttgagcctgggaggttgaggctgcagtgagccaagatcgcgccagtgcactccagtctgggtgacagagtgagaccgtgtctcattaaaaaaaaaaaaaacacacacacacatacacactgtctctgttatgtgcagaatgattagaggaagagaaaatgaggagctaagtttcctcgccacttactaacgtttacgtagtgctgttaggtattattctaattgttatccccattttacagatgaaacagacacaggttagcttgcctaaggtcgcacagatagtagttatagagggtcaaaggcagggagaccacctgccgagttcctgctcttcactattatgcgtcctgtgtctgctacttctgcagtggccctgggtgagagacaatgaggacttctctcttaatctgcacaggttgccttttcctgccttttctatcaggtgacactccacttattcctcaagacccacctcaaaaatcccctcttttctttcctagaagtagttgaccttctgcctactagccatattattttatgcatattgctgctgtcacccttaatacgttatttatatgccttatgctagaaaacatttaaggcagttcactgtaatgagaaaatataaaaattaaacggattagaaaacaagacaaaaagaacattgagattaggaaaaataaagggaagtcagaagtggggtgatcctcaaaatgcaggaggataaa

SEQ ID NO: 47315 - DNA, 1677 bp, Homo sapiens
atcaatggaaatgagaaagcctcctcgaagttaatcccatttttgaagaataaatagatattggactggtgttctgggttggtagccacttgtataaagaccccaagatgttggaagaactcaaagctgacaagtattgctagaatttagaaagttatgagccagagatctctaagggcaataggaatccattaaaagttttaacactggtgtggtgttaatcagattggcattaaaacacacacacatgccgggcacagtggctcacgcctgtaatcccaacactttgggaggccaaggcaggcggacctcttgagctcagaagttcaagaccagcctggaaaacatagtgagaccccatgtctacaaatacaaaaaaattggtctggcacagtggcacacacctgtagtcccaggacttgggagtctgaggagaaaggatcacttgagcctgggaggttgaggctgcagtgagccaagatcgcgccagtgcactccagtctgggtgacagagtgagaccgtgtctcattaaaaaaaaaaaaaacacacacacacatacacactgtctctgttatgtgcagaatgattagaggaagagaaaatgaggagctaagtttcctcgccacttactaacgtttacgtagtgctgttaggtattattctaattgttatccccattttacagatgaaacagacacaggttagcttgcctaaggtcgcacagatagtagttatagagggtcaaaggcagggagaccacctgccgagttcctgctcttcactattatgcgtcctgtgtctgctacttctgcagtggccctgggtgagagacaatgaggactgtgaccaagagggaatgcaaagaggacaggtgggagggaaatagggaaatttgtgaggtagaatgtcaggacttcaggtattgaatggatggtgggagaagggatttaggatgatcccaggtttttgacttcactgtgtgcctgttagtgctacttttctatttattgagattgagatgtccaaaggagcaacaggctttgtcagatgggagatagggacagaagatgagttctaaagtaatgactgcagtcaagtgcccccccacatccttaaaagccacaggaatctctaccctgccacttacagactgtctcagcttcagtctctgaacggagataataataaaatccacatcagcggattgttttgaggattaaacacaaaaagttgtaaagggctttgcattgagtccaacacataataattaatattcagtaaatattaatgtcagagttgttttactaatctgtcttccactttcctttgatgtggactttgccttctctcttaatctgcacaggttgccttttcctgccttttctatcaggtgacactccacttattcctcaagacccacctcaaaaatcccctcttttctttcctagaagtagttgaccttctgcctactagccatattattttatgcatattgctgctgtcacccttaatacgttatttatatgccttatgctagaaaacatttaaggcagttcactgtaatgagaaaatataaaaattaaacggattagaaaacaagacaaaaagaacattgagattaggaaaaataaagggaagtcagaagtggggtgatcctcaaaatgcaggaggataaa

SEQ ID NO: 47316 - DNA, 628 bp, Homo sapiens
aaatggcagatgataccttgggttgggaggggtcctggaagtggactcttccacagtggcatcaggggtaggggtcacagtggtggttaggaccagagctgaggtcacagagctcctggaggcaagattaaggacaaagagtggctccccatcaccaagttgggccatctggtcaaggacatgaagatcaagtccctggaggagatctgcctcttctctgtgcatcaaggaccaggttcaaggcatttgtcaccattgaggactacaacggctatgttggtctgggtgttagtgctccaaggaggtagccagcaccatccatggggctataatcatggtcaagctctttatcctccctgtgtgaggagactactgggggaacaagattagcaagcctcacactcacactacctacccttgcaaggtgactggcagcctgcatctctgtgctggtggcctcatccctgcctccaggggcgttggtactgtcttggcccctgtgcccaggaacctgctgctgatggtggttacccaccactgctgcactttgactggggactgcgctgctaccctggccaattttgccaagggcacctttgatgccatctccaagacctacagctatttc

SEQ ID NO: 47317 - DNA, 591 bp, Homo sapiens
ggaaatgcatacttgtaaactctagaagaaccactgcaaggaacagtcaaaaccccaatagagaaattaaaattaatataaaaacactccgctgaaatcagcaaaggtaaaataagaacaaaaccaaaggcactgaacagaaaacaaataattaaatgattatttgaactaaatactatgtttaaactaagtcttaaatatcaataattacattaaaaggcaatggtctaaacacatcaatgaaaagacagaaactgtcaaaatgtatttttttaaaaagacccaaccatatgttgtcttcaataaacccagattttgtctaggcacagtggctcatgcctgtaattccagcactttcagaggcctaggaaggaggatcacttgaggctagcagttcgagaccagcctgagcaacctagcaagactctatctctacaaaaaatttaaaaattagctaggtgtgcggcacgcgcccttagtcccaagctactcaaatggctgaggtgggaggattgtttaagtccaggagttggaggtggcagtgagccttgatcacatcactgaattccagcctggcaacagagcaagaag

SEQ ID NO: 47318 - DNA, 306 bp, Homo sapiens
ttttcctcttcatcccctctcccagcccttcttgcttccctaaatattttcttgagaggaaacgagggcagcaaagatattaatattgacaggctcaaccctttcctgatggtctcaaagtttaaaagagaaacatagaagatgcaatgcttacccaagtcatacatttgagtggtagatgtctagataatgtcaccagggcaaggcagaggcaagggagatgggggaggagagtagagatggccctggatgtgccaggtgaccatacgctcagcccaagtgagagcccagtcctggtccttccac

SEQ ID NO: 47319 - DNA, 1076 bp, Homo sapiens
ccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggtaaagtgttgggggcctggggcttttgaaaatcattcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaactttaaaatttaaaaaaaaaaaaaaaaagatagaaaccagtcattggaaaagttggttatggaagcttttaaaataagaactaagtggttctagttgctaagattgagttgttgtatattgtttgaaataggctttgagtttctcagaattatactttacaaacaagttatattacgtaaagtgacaaagcaatcatttgactttgattcatg

SEQ ID NO: 47320 - DNA, 317 bp, Homo sapiens
ccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataaggtttgtgaagggtttttgttgtttgttttgaaacatcagaatctgaaatgcggtggaaatctcagtaagccacaaagtaacaaggtgggtcataagctgtgaaggaaaatagtgggtaaa

SEQ ID NO: 47321 - DNA, 1587 bp, Homo sapiens
gataaactctttgtgggtagctagtgctggaagctgaagttagttgaataaaaatcagaccacggtttctatttttcatctagaatgaagatgataaccgagccagtgagagcaagaaacccaaaacggaggacaagaattcagcaggccataagccatccagcaacagagagtacgttcccaaaacatgttgcatgccagtgttgttaatatatgtatatcatttgatagtgggtactttctgacatgctctgagtgttccttttagtaagcaagtgttatataaatgcatacacataacatatgccaaatagtgggagctttcacttttagctaatagggatggaaaacatttaacatttaattagttcttcctttattcattttttattggggtaggggtgagtatggggggagaattaaagtaaagctatgccactttctggttagatggcaaacttatctgtaatttccaagagactggttgccaacttaaaagtggtaatctcttcattcaccattcatcaatttgttcaatcattcagccaatatttattgagtactactgagtggtaggtcagtttttggccctggatttacaaccacgggaataaaaacagagaagatgcctaccttcatggaatttacagtcttattttgttttatagaaatcatgtgtcctagtaatcaaatggggaaaaacagatttgtcttgaaagcagacaaagagaaatggaaaaatcaattacccctgtattactgtgtggagaaatgaaggcattcgtttggtttggcaggtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggtaaagtgttgggggcctggggcttttgaaaatcattcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaactttaaaatttaaaaaaaaaaaaaaaaagatagaaaccagtcattggaaaagttggttatggaagcttttaaaataagaactaagtggttctagttgctaagattgagttgttgtatattgtttgaaataggctttgagtttctcagaattatactttacaaacaagttatattacgtaaagtgacaaagcaatcatttgactttgattcatg

SEQ ID NO: 47322 - DNA, 1003 bp, Homo sapiens
ccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaaggtaagtatgcaaaa

SEQ ID NO: 47323 - DNA, 546 bp, Homo sapiens
aagaaatgctattagtttcatttttaatctccttacggttttcattgtagttatatatttttttggtcaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaaggtaagtatgcaaaa

SEQ ID NO: 47324 - DNA, 1701 bp, Homo sapiens
ccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtacgttcccaaaacatgttgcatgccagtgttgttaatatatgtatatcatttgatagtgggtactttctgacatgctctgagtgttccttttagtaagcaagtgttatataaatgcatacacataacatatgccaaatagtgggagctttcacttttagctaatagggatggaaaacatttaacatttaattagttcttcctttattcattttttattggggtaggggtgagtatggggggagaattaaagtaaagctatgccactttctggttagatggcaaacttatctgtaatttccaagagactggttgccaacttaaaagtggtaatctcttcattcaccattcatcaatttgttcaatcattcagccaatatttattgagtactactgagtggtaggtcagtttttggccctggatttacaaccacgggaataaaaacagagaagatgcctaccttcatggaatttacagtcttattttgttttatagaaatcatgtgtcctagtaatcaaatggggaaaaacagatttgtcttgaaagcagacaaagagaaatggaaaaatcaattacccctgtattactgtgtggagaaatgaaggcattcgtttggtttggcaggtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggtaaagtgttgggggcctggggcttttgaaaatcattcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaactttaaaatttaaaaaaaaaaaaaaaaagatagaaaccagtcattggaaaagttggttatggaagcttttaaaataagaactaagtggttctagttgctaagattgagttgttgtatattgtttgaaataggctttgagtttctcagaattatactttacaaacaagttatattacgtaaagtgacaaagcaatcatttgactttgattcatg

SEQ ID NO: 47325 - DNA, 829 bp, Homo sapiens
  misc_feature (15)..(15): n is a, c, g, or t
  misc_feature (71)..(71): n is a, c, g, or t
  misc_feature (109)..(109): n is a, c, g, or t
  misc_feature (148)..(148): n is a, c, g, or t
gtaaccggtgttatngatgcaccgcctgtactgcagcccagagctcagcaggtaaggcggtggcaggctgngtcctctggctgagccccaccaggctgcagtgttcgcntgggtcctcttccagcaggtccagccaggaaggccctgnaggcccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaaggtaagtatgcaaaa

SEQ ID NO: 47326 - DNA, 392 bp, Homo sapiens
tagtgatgataacaaaggtggtcccagaattgcctaggcatatttttggcatatacaagttttaggaagtacgtaatcatgtaagacaaattagatccatttactgtgaaatattgggagtgagccaattaacatgttattttttaaaaataaattatactaagatttttgttagattaagtttaacttttaaaacaattttttgagagtattccatggatatatcttttgtcccatttcattgtgagtgggtacgttaacattacaatgttccctgggtccaaaatggctcatagaattatatgcctgcaccaaatgagaacttttgttttttaacttctttgaatattgccatctctcctagatattagatccagcagtttaaagtggtt

SEQ ID NO: 47327 - DNA, 429 bp, Homo sapiens
tcttgggtggaaaaaggaaaactggctcctttctttttcttctccaaagagaatccactgaggccaagcactggagagttgtaaccacattgactcctcttgccagagcctccactccccagtttcttgtaggtaattcttctggagcagcggttctcaaagtgtgatctctgaatcagcatcacctgagaaggtgttagaactgtaaattcttggccccaccccaggcctactgaatcagagactctagaggtaggccccagcaatctgtgttttcacaagccttccagttgattctgatgcaggtaagagtttaagaactactgatttaggcaacttgctcttttcatcccttctaaattactccctagttctcttcacccccaggtgtcttcccacttcaccccccacccccaagtgtccatccat

SEQ ID NO: 47328 - DNA, 320 bp, Homo sapiens
ctgcttcaaggaaaaattagttctctattagatgcatcactgactgaaacatttgtttaataaactggtataggcaaactcacctcaaaaagaccaatactggcctgatgatataatcgtatgatgcttctttttctcctataaaggtgttcatagaatgtgcaatcccatgtaaaagctgtgtgttaaagaaaatggtgtaactcttcaaccctcataaggctttgtgagattttatggcatgatcgcatttattgtcatgatagtaattcagtttaataatgttaactagtttcatttggacaacgtatttgccctgg

SEQ ID NO: 47329 - DNA, 402 bp, Homo sapiens
gattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgt

SEQ ID NO: 47330 - DNA, 368 bp, Homo sapiens
gaaaaaggaaagaaaaaaggaaatccagtgcagagtcccagagtgtgggggaaagcacagtgccttctggggacttagatgttcaatgcagtggatcagagagggtgaagcaaggagggacagtctatgagtccagagatgccaaccatggcagatcataaagggcctgagggcataaggaagccagtggaattctgaagctcgttaaagtgtaggatagtggatccaagaccatttgaataaagccatcagactctgacattgctcattttctttttaatgtgtttatggcagacctggctgaagggagggaggatatgtttatcccaggctcagatggcaggaagcatgcgagacatcagaatggg

SEQ ID NO: 47331 - DNA, 430 bp, Homo sapiens
ttcctggaggacctggagccccattgcaaacaagaaccctggagactccattgaccacctagaacctcgagccataggtgtgtggagattagagctcatcatatctctggccatgtctgtgtctagtgtttgaatctggaagagtttatgaagaggttagaattcatttctatcttaatccaggctctgttccaatctgaaaagatgagcagagtagactgctaatttcattcacttaaaaaaaaatcatcagcttacatgagctgacccattaatattactaattttaatatttcatttgggaaaaataatttttgcaatgttgtaagaagtaagtgttatggagtagggagatggaaagttggaatgtttggaacataggatccaaccgggattaaagggggcgtcccctactttttctaaatctggc

SEQ ID NO: 47332 - DNA, 571 bp, Homo sapiens
gtgagtatgccgtttcctcaagttttacctcctgcaacttaaaggcagattttgcagcaactttttggtaaactgtcaactagtggcttgctgttggactgtacttctctgagtgaggtgctgtgaggacccctggaaggacacaagggcagaatagtgaaggccgacgctgacttccagaagcaatgagtgggagacatcttcctgccacaccctgagcaacacagttgtgaagagtaaatagacactagtagcttctagactttttccgaattctcatcacataaaatatctccttgtgaaattctggcttattgaggacaaagaagattctggaacacaaaccccaaacagcgcatcttcggaaacatgcctgttttcaacataagaagtaatccacgcttcaggggctagcacaaagccacagttccactttgagtccttcagaagtgacaaagaccaaatgtggcccagtatgtgaggcaaggcggaagtaggaatttcatgctgttttaaggttgcttagtgtactttaactgaaggtgtaataaaagcaaattctaataaaatt

SEQ ID NO: 47333 - DNA, 396 bp, Homo sapiens
tccacaaatccctgtaaagatagagaataacaacttcattataaagactggtatgtttcagaatatatttcttttatttttaccacttgtacacatattatactacagagacaaaatccctaatagctacatacatacatatgctctccaagtatcttaatttcaaacatgattgtcctagtgactgaatgggtgtgagttatgtatactttatcatcctggtggttcatattcactatcagtgaaaattaggcagtcagaaaaaagtaaaagggctcactactctcaaaaaccagaatttctaaacagactaggccctaaaaagggaagaagaaaaaaattacagagcagaaagggaatcaaaatcagaagggtgatgagtgaaagaacatggca

SEQ ID NO: 47334 - DNA, 424 bp, Homo sapiens
gagcatatccatatttgtaatggtattttccaatgtcgctgtaggcatgggggtaagaaaatgtattagctgtggaggagatgttaagagtatacggaatgttactcatcctaagggaatctttgtgtttctgaggagagacccctgggccttttcgttgttcttcagtgtgggccacgttcactttcagacagtaactctgtagggataactctgtcagtggtacgttcagtccttcatctcacgcttcttcatctcactcttctcgagaatgctggagtcattggtatcctcagttccagtattgttaaaggtgaatttcaaattactagtctatttcaaaatactattgaattccaattagctcaccttttgtagaaagatcagctatttgttcaagtgtgtactgacttgaaaagggcct

SEQ ID NO: 47335 - DNA, 930 bp, Homo sapiens
gcagtttgatcgtttgaagccttcttctctcagctcgtcaaagtcattctccgtccagttttgttctgttgcgtgaagacccactacgttatgtgagactatggggaaagctgaaatttggttaatccgaacatattgggattttgaatttcctcgtccatacttacctaattttgagtttgttggaggattgcactgcaaacctgccaaacctttacctaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatattcttaagtttggcaaaatcctgagtagtggaagtcctattaattccagacaaaagggagtttaacaaaaacacgtcttccatcctggttcca

SEQ ID NO: 47336 - DNA, 1766 bp, Homo sapiens
aaacttcagcagagaaaaacatttgcttcacatctcatcaaatcttctgcatcaagccacatcatgttaaacaaccttctgctgttctcccttcagataagtctcataggaaccactcttggtgggaatgttttgatttggccaatggaaggtagtcattggctaaatgttaagataattatagatgagctcattaaaaaggagcataatgtgactgtcctagttgcctctggtgcacttttcatcacaccaacctctaacccatctctgacatttgaaatatataaggtgccctttggcaaagaaagaatagaaggagtaattaaggacttcgtttcgacatggctggaaaatagaccatctccttcaaccatttggagattctatcaggagatggccaaagtaatcaaggacttccacatggtgtctcaggagatctgtgatggcgttcttaaaaaccaacagctgatggcaaagctaaagaaaagcaagtttgaagtcctggtgtctgatccagtatttccttgtggcgatatagtagctttaaaacttggaattccatttatgtactccttgaggttttctccagcctcaacagtggaaaagcactgtgggaaggtaccataccctccttcctatgttcctgctgttttatcagaactcaccgaccaaatgtctttcactgacagaataagaaatttcatctcctaccacctacaggactacatgtttgaaactctttggaaatcatgggattcatactatagtaaagctttaggaagacccactacgttatgtgagactatggggaaagctgaaatttggttaatccgaacatattgggattttgaatttcctcgtccatacttacctaattttgagtttgttggaggattgcactgcaaacctgccaaacctttacctaaggaaatggaagaatttatccagagctcaggtaaaaatggtgttgtggtgttttctctgggatcaatggtcaaaaaccttacagaagaaaaggccaatcttattgcctcagcccttgcccagattccacagaaggttttatggagatacaaaggaaagaaaccagccacattaggaaacaatactcagctctttgattggataccccagaatgatcttcttggacatcccaaaaccaaagcttttatcactcatggtggaactaatgggatctacgaagctatttaccacggagtccctatggtgggagttcccatgtttgctgatcagcctgataacattgctcacatgaaggccaaaggagcagctgtggaagtgaacctaaacacaatgacaagtgtggatttgcttagcgctttgagaacagtcattaatgaaccttcttataaagagaatgctatgaggttatcaagaattcaccatgatcaacctgtaaagcccctggatcgagcagtcttctggatcgagtttgtcatgcgccacaaaggagccaagcaccttcgggttgcagcccatgacctcacctggttccagtaccactctttggatgtaattgggttcttgctggtctgtgtgacaacggctatatttttggtcatacaatgttgtttgttttcctgtcaaaaatttggtaagataggaaagaagaaaaaaagagaataggtcaagaaaaagaggaaatatatatattcttaagtttggcaaaatcctgagtagtggaagtcctattaattccagacaaaagggagtttaacaaaaacacgtcttccatcctggttcca

SEQ ID NO: 47337 - DNA, 398 bp, Homo sapiens
tttgttatgaaaggaggctctgggtctgatatgcttgaaaatcacagggcaagggcggtagttcccgaggcagcagggagaggcactcaggggacatgtggattcacggtatcagcaaacacagggacgaggggtccactgtctggctctttgcccctgtttctctggaggtcagcactggtggccggtcagagccggctctgcattctggaaccttagccgtgacagtgggcctgggaaagtcggtgggtctccccatggcctcaagaactcatggcctgttgttgccacagtgtcttaggctttgctggggcttttgagctcacgggacagttccatacaccccactccacccctaccactccagtgagcatactttctccagtgtgcatgggccc

SEQ ID NO: 47338 - DNA, 450 bp, Homo sapiens
gaaattttactgtttgattgattataaaagaagtatagtcagtgtgtaatgtgatgtgtaaaaaggtgtaaagaagaaactgaaagtcacctataacccattaataattacctgtaactggtattgttgtgagtgtgccctcagtttgtttatggcaaacatgatttttaaaacaaaatctggatcattaaatattttcttaacattattctgtagacaatttcattaattataagggctagtactctcaagattttttttgcttttcttccattttgtaacctcttggggaccaagacacatttcttttcattgtttctcattttctctattgataacaaaattttgtggtatagagttacagacttttgttgataaagaagggactttaggacaactagataaacaactttatgaaacaactagataaacaactttataaaagtgaca

SEQ ID NO: 47339 - DNA, 350 bp, Homo sapiens
taatagggtccttattgggtacacctgtcattttaatttatataggcaggtccaaaactcatttttatggctcagtttctgtaatgtaagattaataatgcctgtattgtagtcccatctacagaagtcacaaataaaattaaatcctaggaattaaccaaagaagtgaaagagctctataatgaaaactataaaacatggaggaaacaaattgaaaagaacacccaaaaactggaaagctttctacgttcatggataacaagaatcagtattcttaaaatgtccatagtactcaaagtaatctacagattcaatgcaatgtctaccagaataccaatgacattcttcac

SEQ ID NO: 47340 - DNA, 921 bp, Homo sapiens
ggtttaaatgctccacataaaacaagcttgtccaatccacatcccatgcactacatgttgcctaggatatctttgaatgcagcccaacacaaattcttaaactttcttaaaacattataagatatttttgcatttttattttatttatttttattttgctcatcagctgtcattagtttatgtgtggcccaagacaattcttcttcttctgttgtggcctaagtaagccaaaagattggacacctcttaactaaaagatacagattggcagaatggataaaatatcaaaagccaaataagtattgatttcaggagacacacctaacacgtgaggattcttatggacttaaggtaaaggagtggaaaaagatatttcatgcaaatggaaactaaaagcgagcaggaatagttattcttatatcagataaaactgtctttaaagcagtaacagtaaaaaaataaaaaaaaacatcattataggatgacagaagggatcaattcaacaagaagatataacaatcctaaacatgtatgtgcccaactctggagtacccagattcataaagcaataccactagattaaagaaaagagatagcaacacaacagtagttgtgactttaacactccactgacagtgctagacagatcactgaagcagaaatttaacaaagaaacactggacttcaactgcgctctagaacaaatgaacctgcaccgtaaacaaatgaacctaatagatattcacggaacattctacccaaaaactgcagaatatacatttttctcatcagcacaaggtataacacattctccaagatagaccatatgataggccacaaaatgagtctcaataaatttataaaaatagaaatcacatcaattatattctcagaccacagcaaaataaaactagaaatcaa

SEQ ID NO: 47341 - DNA, 406 bp, Homo sapiens
agagcatcaaagcattatcaccgacccaacacacaccggcgctgcgtagtttctgcagcaggtgtggggtgaagagttgccacacagctgtctgacaccgggtgtacggcgtcacccctcacttcctggacaaggcaacattttcctaaaggcacctggagacattgagtactgccaatggactgctgaaccaaacgaagagcttttctgcaacattcatgttgcagaggagatgggaactgccactcagctgctgccactcagctactaaatctgaaatagttattcagcaatacaaaaatggtattgcggggttctggggcagcccctttggctcaaatgccagagctttctgctatacctactgagtttcagtagattttattgaataaaagtttctcaattc

SEQ ID NO: 47342 - DNA, 777 bp, Homo sapiens
tcccagcactttgggtggccgaggcgggtggatcacctgaggtcaggagttcgagaccagcctggccaacatggtgaaaccccgtctctactaaaaataccaaattagctaggggtggtggcaggcgcctataatcccagctacttgggaggctgaggcaggagaatcacttgaacccgggaggcggacgttgcagtgagccgaaatcattgcctttgcactccagcctgagcaaaaagagctaaactccatcttagaaaaataaataaataaataaataaataaaggatttaccagagcatccaagaaatattattaaatacttgatcccgtgaaaccactcccctatctgttaacgatttttaaaattttacagatttcgaaaatcttcttctttatccttggacctaacctatccacagggtccctaaccatgctatgcagttcccacctctaccagaagtgctgggaaaatcacctaggttatctagcttccctcaaagtattttacactgttgtgagatttcctttaagattcaggagctaaagtttattttctttctggtttcctggcggagcaaaggccctgcacgtgtgaacggaaacaaaacccacacagactctagggatgccaaatattaacactgtgggtaggggcaccttccttctcggccgaattccctttcccagagagcctccagagggatcagtcaacgcccactgagcctggatcaaaggtcaagcttgcctggtcaagaaggatcctggatcaagctt

SEQ ID NO: 47343 - DNA, 428 bp, Homo sapiens
ctattttggtaaaaatatctccatacacatgtctgtacattcatagataaagacttggaagaaatgtggcaaaaatactaacagtgttgtatctgggtattgagtttaaagatgaatttattttcttctttgttcctttctatattgcttgatttcttttgcagtgaggatgtaccagtttttttaattttatttttgaaatagagaatacattcacaaagtaataatcaagagtctaaaagattatacaataaaaattcttctctcgtccctgtctgccttccatctggctccctccagaggtaaacagtgtgaccagcaactagtgtatccttttagagactttatgcacatataagcaaatatatgtttgttttttcctattatcacttttacaaccaaaatacaataaaactaccttgattttg

SEQ ID NO: 47344 - DNA, 503 bp, Homo sapiens
ctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaat

SEQ ID NO: 47345 - DNA, 430 bp, Homo sapiens
gatatagtaatgacagtagttacaaaactactatgtcattgtcacacctaacaaaattagtaataactccttatctcatctaagcacctccatgccctccttgagccaacaggatattttgtgtcttttttttttttttttttaaatgagatggagtctcactctgtcacccaggctggagtgcagtggcgcgacctcggctcactgcaagctccgcctctggggttcacgccattctcctgcctcaacctcccgagtagctgggactacaggcacccgccaccacgtccagctaatgttttgaatttttttttttttttttttttttgatatggagtcttgctctgtcgcccagactggagtgcagtggcgcgatctcggctcaccgcaagctctgcctccagggttcacaccattctcctgcctcagc

SEQ ID NO: 47346 - DNA, 1054 bp, Homo sapiens
agtatcaggggacctgagtgggaattggagtgctgatggctggggctgcatgcctaggagccagcattcctgcaactggatgccccagccaagagttggcaggaaagccttggtagctaggcagccgagaacatagcacggacactgctaagctgacctaggtgcacatcagagaaaccctcctctgaaattgatgaccacctggctgcagttgctagtgaccagatggtgaggagctagtggatagagggtgggccagggcctcaagacagctcttcactctccactctgcactctgattccgctatttcttggctctgggttctgctgtcaaagtcccaggggccactattgtgggctctcaccctgtatccaagccccacttcacctgcccccttgtatagctgccttcctcacatccctccagcttgcccacattttgctcacggatgggggcagactctactgttccctctgcacctgcatctctctccttcaggcctttcatgtacaccgggaccaccaaagggccatgaactctttgtcagtcaagtcccaaggtcccatagagagcagatggccactttaatgtcacctcaagcccttaggctgtttttagacatccatctccttagtggatgctttttatagacccccatccaagacctcacacatcttgtaattaaatttcatctggtagtattttgactttttttccagcctgtcaacaccttctgtgttcttacttgttgtatctcaaatatttgatacccttttcagtgttgtattaatctaaaatttgttgtttgtgtttatgttttcatgaagttactgttaaaaaatataggaagaagagaaggttaagatttgagcccttcagtgtatagttgagcttgtcctggaagacatcagccatttaagaatcactaagttggccgagcgcggtggctcacgcctgtattcccagcactttgggaggccgaggtgggcagattgcttgagcccaggagttcgagatgagcctgggcaagtggcgagaccccgtccctatatt

SEQ ID NO: 47347 - DNA, 999 bp, Homo sapiens
agtatcaggggacctgagtgggaattggagtgctgatggctggggctgcatgcctaggagccagcattcctgcaactggatgccccagccaagagttggcaggaaagccttggtagctaggcagccgagaacatagcacggacactgctaagctgacctaggtgcacatcagagaaaccctcctctgaaattgatgaccacctggctgcagttgctagtgaccagatggtgaggagctagtggatagagggtgggccagggcctcaagacagctcttcactctccactctgcactctgattccgctatttcttggctctgggttctgctgtcaaagtcccaggggccactattgtgggctctcaccctgtatccaagccccacttcacctgcccccttgtatagctgccttcctcacatccctccagcttgcccacattttgctcacggatgggggcagactctactgttccctctgcacctgcatctctctccttcaggcctttcatgtacaccgggaccaccaaagggccatgaactctttgtcagtcaagtcccaaggtcccatagagagcagatggccactttaatgtcacctcaagcccttaggctgtttttagacatccatctccttagtggatgctttttatagacccccatccaagacctcacacatcttgtaattaaatttcatctggtagtattttgactttttttccagcctgtcaacaccttctgtgttcttacttgttgtatctcaaatatttgatacccttttcagtgttgtattaatctaaaatttgttgtttgtgtttatgttttcatgaagttactgttaattgtcctggaagacatcagccatttaagaatcactaagttggccgagcgcggtggctcacgcctgtattcccagcactttgggaggccgaggtgggcagattgcttgagcccaggagttcgagatgagcctgggcaagtggcgagaccccgtccctatatt

SEQ ID NO: 47348 - DNA, 902 bp, Homo sapiens
agtatcaggggacctgagtgggaattggagtgctgatggctggggctgcatgcctaggagccagcattcctgcaactggatgccccagccaagagttggcaggaaagccttggtagctaggcagccgagaacatagcacggacactgctaagctgacctaggtgcacatcagagaaaccctcctctgaaattgatgaccacctggctgcagttgctagtgaccagatggtgaggagctagtggatagagggtgggccagggcctcaagacagctcttcactctccactctgcactctgattccgctatttcttggctctgggttctgctgtcaaagtcccaggggccactattgtgggctctcaccctgtatccaagccccacttcacctgcccccttgtatagctgccttcctcacatccctccagcttgcccacattttgctcacggatgggggcagactctactgttccctctgcacctgcatctctctccttcaggcctttcatgtacaccgggaccaccaaagggccatgaactctttgtcagtcaagtcccaaggtcccatagagagcagatggccactttaatgtcacctcaagcccttaggctgtttttagacatccatctccttagtggatgctttttatagacccccatccaagacctcacacatcttgtaattaaatttcatctggtagtattttgactttttttccagcctgtcaacaccttctgtgttcttacttgttgtatctcaaatatttgatacccttttcagtgttgtattaatctaaaatttgttgtttgtgtttatgttttcatgaagttactgttaaccttaagacatcacctttaaggatccctagtttgcccacccggtggttaccgcttttttccaat

SEQ ID NO: 47349 - DNA, 396 bp, Homo sapiens
gtatgttctctcatagggttcttatttactcttggtaaggtgagtctcaatagattataatgtttattgctgtagtttaactgtggattttgtttttatcttttgaaaatacactttcttttaagtgtattattataggcataccttggagatactgcaggttcagttataggccactgccattaggtagtgaatattgcaataaagtgaatcacatgaactttttggttttctagtgcatatagaagttatatttacactatactgtagtctcttaagtgtgcaatagcagtatgtcttaaaaaacaatatacataccttaatgaaagtatactttattgctaagaaatgctaatgatcatctgggcctttagtaagtcttaatctttatgctga

SEQ ID NO: 47350 - DNA, 758 bp, Homo sapiens
gagacggagtctcgctctgtcgcccaggccggactgcggactgcagtggcgcaatctcgtctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacctgcctcggcctcccaaagtgctgggattacaggcgtgagccaccgcgcccggccggcttggaatttttaatagtggttacaatgtgggcaggggcttgtgtggtttggatttcctgcttgcaccaacaaagagcatccagactttcacatgagcttgcccagatgcaaggcacaagggggtgagggaaagggaaggcttaaaagttgttagcaggccgggtgttgtgactcaaaatactgtaatctcagcattttgggagacctaggtgggtggatcacttgagcccagaggtttgcaaccagcctgagcaaaatattgagactcctgtctctccaaaacaataaaaaataaataaacaaataaataaataaatggctagacataatggtgtgcacctgtagtcccagctgtttgggaagctgaaatggaaggatcgcttgaggcccagagtctgaggctgcggtaagctgtgttcgcaccactgcactccagcctgggtgatagagtgagaccctcgtctcag

SEQ ID NO: 47351 - DNA, 1901 bp, Homo sapiens
  misc_feature (4)..(4): n is a, c, g, or t
  misc_feature (119)..(119): n is a, c, g, or t
  misc_feature (1271)..(1271): n is a, c, g, or t
ttantagtgtatggcaggaggcctgccagccctgtgtgccttggatgtggggcaactaaagcgcactccccacttttaagaagccattgacccagtggagtaaacaaacatgaacaacnaacaatatcacaatgaaataagtgtgagtggtatgtcaggagagccccaaagagggaagatcagaaaaggcctgacagaggtgaagctgggctgggaggaagggaagtgcctcttgattgaggctctgctctttctcctcttcccttcttcctgtgtctcctcactttccttccaccagatcctttccacttccccagccccgctattgtctggtcttagagggcaggaaaacgaggtctgctggtctgctttcagattttgtttaactatagaagtgctttggtttctttgtggtttctttgagcttttcagtgagaaagaagaaggcagtgggaatacattggaaataaacttatcagtgctttgtagcatcaccactgtggtgtgattgccccttgaggcgtgtgagaggaaaggtggaggaagatgaggctgacaaggttaagtggggcagagtgctctggcactactgggattgtagggaggggaaccgagggacatcatggcacaaatctggaacccgagcaaagcgagttttctgaaagataactccagcagtgatgtggagaattcttttaatggcaagagaccagatgctgtggttaccttgcagaagcaaggtggatccccaccctaaatttagtttggatgtcaagattgacgccatcacacataccaagagagcatgcacatgtttattacttacatcaagcttgtccagcccacagcctgcgggtcgcatgtggcccaggatggctttaagtacagcccaacacaaatttataaactttcttacaacattttgagattttttttttttgctagttgttttttttttaagctcatcagctatcgttagtgttagtgtattttatgtgtggcccaagacaattcttcttccagtgttgctcagggaagccaaaatattggacgcccctgacttacatgatgaggctttctggggaagaacagggaagacatcccaagctagttcaaaacagcttgggagagcaagaaaaaagactggcttgggatttgattttcatttatttttatttttagagatgaggtctcactatgttgcccaggctggtcttgaactcctgggctcaagcaatcctcccaccttggtctcccaaagtgctgggatnacagacatgagccaccgcgcccggctaattttttgtatttttagtagagacggggtttcaccttgttagccaggatggtctcgatctcctgacctcatgatccacctgcctcggcctcccaaagtgctgggattacaggcgtgagccaccgcgcccggccggcttggaatttttaatagtggttacaatgtgggcaggggcttgtgtggtttggatttcctgcttgcaccaacaaagagcatccagactttcacatgagcttgcccagatgcaaggcacaagggggtgagggaaagggaaggcttaaaagttgttagcaggccgggtgttgtgactcaaaatactgtaatctcagcattttgggagacctaggtgggtggatcacttgagcccagaggtttgcaaccagcctgagcaaaatattgagactcctgtctctccaaaacaataaaaaataaataaacaaataaataaataaatggctagacataatggtgtgcacctgtagtcccagctgtttgggaagctgaaatggaaggatcgcttgaggcccagagtctgaggctgcggtaagctgtgttcgcaccactgcactccagcctgggtgatagagtgagaccctcgtctcag

SEQ ID NO: 47352 - DNA, 331 bp, Homo sapiens
cgttcattcatgatattgtcctgcccaattgatccctgtgttcagcaatgtcgcctgagaaaggggcaaaaagaccaattctagaactttctttcccagcatggtgtggtgaaatagttctttggcatggacgaggaatgcagggtttggatcacactatgctttatgaacttgggccctagttctcttcatccataaaatggggtttgtatgattttgttagatttgtaaaaacccatctgataaactggtgaacatgataggacaagttccgtcctggtcacagcttatatgagtgttgtggatgctaccataagtgcttccccatctc

SEQ ID NO: 47353 - DNA, 734 bp, Homo sapiens
tgggattataggtgtgagccaccacgcccggccgatgccaagctaatttttaaacattttttgatagaaatgaggtctcattttgttgcccttgcttgtctcaaactcctggcctcagtcctcctgcctcagcctcccgcaacgctgggattatgggtctgagccactgcacctggcctctccgtatttctatgattctcaatattcccatggacggctgtgacccagtcagtctgcactctcgggaggacatctgctcagataaaagcccagttcagggaaggctctgtcttcaggatcccaaagaaacttgaggcttctccatgaggggaaaaagtagtgggctgaggtgattctagtttatccttctataaaaatctttacccacagaatgggacgctgtgcagtcattaactagaacgataaatacttacattcagaaacagaaaagtgcctgtaacgttgtgctggcttgtaagaacagagaatagagttcatgtaaaatgagagacacacacaaatacttctctaggcatctgtgcatatgtatctgcaagaatgttcactgaaatgtcaccaccggaatcacagaatgtctccttcattctcagtacttttacaatttatactatctgctcagaagatctcctttatataaagataaacaaaaagaagaaaagccacacaaaaaatgtgtgagaaacaaactaaaaatctccaaaccccagttcacc

SEQ ID NO: 47354 - DNA, 679 bp, Homo sapiens
tgggattataggtgtgagccaccacgcccggccgatgccaagctaatttttaaacattttttgatagaaatgaggtctcattttgttgcccttgcttgtctcaaactcctggcctcagtcctcctgcctcagcctcccgcaacgctgggattatgggtctgagccactgcacctggcctctccgtatttctatgattctcaatattcccatggacggctgtgacccagtcagtctgcactctcgggaggacatctgctcagataaaagcccagttcagggaaggctctgtcttcaggatcccaaagaaacttgaggcttctccatgaggggaaaaagtagtgggctgaggtgattctagtttatccttctataaaaatctttacccacagaatgggacgctgtgcagtcattaactagaacgataaatacttacattcagaaacagaaaagtgcctgtaacgttgtgctggcttgtaagaacagagaatagagttcatgtaaaatgagagacacacacaaatacttctctaggcatctgtgcatatgtatctgcaagaatgttcaaatttatactatctgctcagaagatctcctttatataaagataaacaaaaagaagaaaagccacacaaaaaatgtgtgagaaacaaactaaaaatctccaaaccccagttcacc

SEQ ID NO: 47355 - DNA, 203 bp, Homo sapiens
tttcaactcagacatcacatttaatatgaagacatttacagaatgtaaatcctaaatatggatagagttaaacataaaggtattgccactggaaaggactcttatctcttgtgaaataaatccagtaggaagctgttctcaggaatgccttggccaggtacacagctcactgtgcttgagtagtgctcctgctatttgctaag

SEQ ID NO: 47356 - DNA, 652 bp, Homo sapiens
tgatcacaggagggtcttctctgggctctttctgctgtgaaatccagaagttatgaagtttccacctacttttgaaatcttaacccacttgtttgttcattcccctaatggcccataatgacatcccacctgttaaggaaagagcaggtcctcggaggctgaacaaggccagctctggagtcgaatccactggaatctggagcaagcccctctggcctcggggttgggttcttgatacttgtcggcttgcccaggtgccctaccttcagaccccgggaccctgcgtagtgactgctgtgacagatagcaccagccttgggtttccgatctgcctccgaggcacctgctgttacgtcctcgggccagtcagcagtcccccacccctgagttgtcagaattaaacggcacaatgaattgaacgtgtttggcaccgtgcctggtgtgtggactcagttgatacttgttgaccgaaggcaaatctacagaaaagcactaggaagaaagggaaagtcactcggctgtgccacatgagctttcaacctatgccgagctgcctccagcccgcgccacccccctgcgtctacggctttgcagtcacaagatcctttgtatgtgctgtctatatataatcgctttgtttcacaaagatctg

SEQ ID NO: 47357 - DNA, 337 bp, Homo sapiens
gccttcaagcttctaccacctgttgccttttctcattgcaattattacagattgcctgatttgctctccctcattccttgaagattttagcacctggatcgctgtctctttctgactctctatctgtcgtaattcatgatggtttttaatatccacacagagatcctttcaaaacccaggagtaccagcgacattaagtaacactctgtgctgttacaaaccaacctggaaatctcagttgcttaacccaataaaagatgatttcttgcttgtgccaaatccaatacacctctatggtacttacctggctataccccatgcctgttcaaagccaact

SEQ ID NO: 47358 - DNA, 1244 bp, Homo sapiens
cagagccccctctcggctgctggcccgggctcgcccgcgccgctgggggctctgactcctgccgagccgggcctgggcagcgccccccgcgccccgcgagcccgcgcccccgtcaccgggaaacgccgtagccggcgatccgcggtcgccctgggctcggcgccggcccagccaggaccccgggagcgcacgggacgggcctcgccagtcacactccagcgcccccacgagccagcacagtgcctgctctcagtgaaaggccactgttctccttgggtgacccccatgatgcctgaccgctcctcgtgcctcctggaacagccagggtccttatgaagtggtgaccactccagtcagcaggggtggaaaatggtaccagtcaaacccgaggcggaggaggagcagcccgcagtcgctgccgcgagatggaggagcccacgcccgagcccgtctatgtcgacgtagacaaagggctgaccttggcctgcttcgtcttcctctgcctcttccttgtcgtgatgatcatccgctgtgccaaggtcatcatggacccttacagcgccatccccacatccacctgggaggagcagcacctggacgactgaggcacagcggctgtggggactggacctggcgctctgtgggtggctgtgccccaggatgcatccgtgtgttccctgccagcctgccatcccacagaggcaaggaatgaatctggccacccagggaaacagaaggtgcagcttagccctctcagccctccctcgagcaccagcgtggaatgcccgggtgccgtgggtgtcgcaaccatggaccagccaggggaaaagagccctggaccaggacccaggaggctggggttccagtgtggggagtccctgtgagatgatagggtagtcaccttcccaggttcctgggcaccttttggaactggatccagcaacagacaccccccatccatcacataacagtggtcttgtcttgaggagactctcggtcctttaaatgcaaagtagcaatggaggctcccaaccaagaggtcccacctgaaccccagccccctccccatggactagcagtggtgtggcagtgaggggggaaagcgggttgagggagtctcacctgaaaattcacaaaacgcacaggatatgggctgcttccaagcagtatttttttaaactaaaatatagagggatatatttttcctgttataaataaaatgtacattttagaaacttgggaaa

SEQ ID NO: 47359 - DNA, 415 bp, Homo sapiens
ggttatcagaaaccacttaaccttcatgcttagtgtctattctcaacagacatctggcagaattaggaggtgagccatgttcctggagccctggcctatgccagctgggaaggcagccatgcaaagtcttgctgctaacccccagcccagcaacaggactgcatttaaacaaataaccaaaaatactctctcttaaacacttatcctgtgactttcatgactcatattatcctggttccccttccatttattgatcctctcaggcttggctccataatttgtggggcccaaagcaaaatgaaaatttgagttcccttgtttgaaaagcaagaaaaattactgttaaagttactcaatataattctgttatcttttggcactttctctcgatttgtcatggaatttttttatttgc

SEQ ID NO: 47360 - DNA, 532 bp, Homo sapiens
ccgtgaaaatttgaacaccgattgtttaactgatattaaggaatttataaaatttaagtgtgaaaatattatagttacgttaagaaaatagttgtcgtcggctgggcgcggtggctcgtgcctgtaatcccagcactttgggaggccgaggcaggcggatcacgaggtcaagagatcgagaccatcctggccaacatggtgaaaaccctgtctttattaaaaatacaaaaattagccaggcgtggtggtgtgtgcctgtaatcccagctactcgggaggctgaggcaggagaatcgcttgaacccgggaggcggaggttgcagtgagccgagatcgtgccactgcactccagcctggctacagagaaagactgtctcaaacaaaaaacacaaaaattagccgggcatggtggtgggcgcccgtagtccagctacttgggaggctaaggcaggagaatcgcttgaacccaggaggtggaggttgcagtgagctgagattgtgccactgcactccagcctgggcgacagagcaa

SEQ ID NO: 47361 - DNA, 810 bp, Homo sapiens
  misc_feature (1)..(1): n is a, c, g, or t
  misc_feature (5)..(6): n is a, c, g, or t
ntttnnttttctacatataaaagtaaaataacactctaaaataacataaaaagtataggcatgagccactgcgcacagcccatttatattaaagtgaagttgattatagtttcatatgtcttaaggaccattaaaaaattttttttggtgaattatttattcatattttgcttatttctcaacaggatatttgtttttttccttcaattttttaaagttcttcaagtattagggataatgtcattatctgtgaagtgttttgcatatatttgctcagcttgttttttgactttgcttgttttttgtttttattcttttttgccacacaagcctttttaaaaaaacatggtccactgtgggaggccgaggcaggcggatcacaagatcaggagtttgagaccagcctggccagtatggtgaaaccctgtctctactaaaaatgtataaaaatttagccgggtgtgatggcgcacgtgtagttgcagctactctggaggctgaggcaggagagtcacttgaacctgggaggcggaggttgcaatgagccaagatcgtgccactgcactccagcctgggcaatggagtaataagaccctgtctaaaaaaaaacagacacacacacacaaaagtagtcatatctatcaatctttttaaaagttgcatctggatttcaagtggtagtttaaaagcctttccatatatcaaggttatagaaaagttcatgcgtgtttcttctagtacttgaatggttttgtgttttacatttatatatctaatccattttgagcttattttcatgtatgctgtgag

SEQ ID NO: 47362 - DNA, 317 bp, Homo sapiens
ccctctgccaggctctgggggaagtttggtcttggactctcgtcgtggagccgcttaaacctgtgggtctgaaggccgcgaggccgggtccctggagttggcctcccaggccgttccactccctcccccaacccccgcgcggggcctccggattggaggtgtttcacccacgtgctggtgggcccgtctccctgggccgctgggtgccctgagctgtgttctctgctgcgcgttccttcctgtgtgtggcgggggtgctgacccgggggtgcccaaggcagcccggactcccatcccgtggagctgcctccgggagc

SEQ ID NO: 47363 - DNA, 777 bp, Homo sapiens
aggtttcaccatgttggccaggctggtctcaaactcctgacctcaggtggtccacctgccttggcctgctgggattacaggcgtgagccaccgcatgcagccttatcctgcttttttaatatgaattgtacctcgggtaaccaaatagatagtggaaagcatctatttttagaaggactctggcttataaatgaaaaaggaacgatagactatcagcactttccagcccctaaataaaatgatggagatagtgatcatcggtggctgctaaaacaattagattgaaatgctgatgggaaactttataataagtggatcagatagaccacatctatcccactgatatatcttagcatctcaaaaaagagatcatagatgttttgtgtgttctgatgtggtgtggtaggaagtatcaccataagccctatgaagttttcttgcctaaaataaaatctgaatcctgagcaagcctctagatttcgattctaattttcaggaaatgcaagggacagaggaccatacgattagcaaaatacagaatgtgtgtaactacaatacagtttactagttttttctctaagtaaattggaagaaaaagtgagagaaacccatagattaaaagatacttcaagacatgtgttagccaaatgcagtatatgtgggtctattgatttgaacaaaccaactgtttaaaaaaagtggtttttccctgtaaatttgggacattgactaaataatttgatattaaggaattatagtcattttctgaggtgtaaa

SEQ ID NO: 47364 - DNA, 616 bp, Homo sapiens
ggatataggttaaaatcttctcggtcaccaggcgatgaaggtgatactggacttgatcaaatttagtcatggagagaacaagggatataccattggatatatttaacacatgtttaaaaagttttaaacatttatctatgcaacaatattaagtaacacctacttttgcttgtaaatatttatattctccaattttaaaataataaaagaaacaaaaagagcctggcacttaggatcatagtgatgagttgctcatctatttcctgtctgatcactaaatacctgccagtgactcctctctccactctattttctgaatgactcgacactgccttttaacttaactgcatctggtccacagtgttcttaagtcactcattatacgtcagtgtttctcacatgagctgcaggctggaatcatttggggagctttcaaaagttctaatgtctagatcagacctcgagcaggattctggtttaattgatttggggcatggcctgggcatcaggattcttaggcacttctccaggcaattctaatgtgcagctgaggttgaggacctcgagaagcaactgctactctgaaatgcatcctctattggatcatctggccccg

SEQ ID NO: 47365 - DNA, 313 bp, Homo sapiens
cccaaagtcctgggattacatgtgtgagccacagcgcccagcctctaggactttcataaatagagagaagtcagtgcctagtttcaaaggacagcctgactctcttgttaggggccagtgcagctggtgactttaagttgaagccagtgctcatttaccattctggaaatcctagggcccttagggattatgccaaatctactctgtgctctttaaatggatcaccaaaggctggatgatagcacatctgtttacagcatggcttactgaatattttaagcccactattgagtcctacttctcagaaaaaaaa

SEQ ID NO: 47366 - DNA, 771 bp, Homo sapiens
ccgaccggagcggcgccccgggggcggccgccaccgaccgcagccgcacgccccgcgcgccgggcccgcccgcccacggggcccgccacgccggggggcctccgctcccggcggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggttctggaacactccca

SEQ ID NO: 47367 - DNA, 4959 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47368 - DNA, 3264 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47369 - DNA, 3254 bp, Homo sapiens
ggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47370 - DNA, 3342 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaagccattcaaacccctaccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47371 - DNA, 3344 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgggcctttacgacacttgggggtcttctcttctctgcccctgcctggatatgtgttgcttgaccgcaggcatccagggaggctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47372 - DNA, 3040 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47373 - DNA, 2922 bp, Homo sapiens
gaaccttctttatgatccttgatagtggtgtctgcaactgattctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47374 - DNA, 3280 bp, Homo sapiens
ttgccgggtcagccctgacaaaggtcagctagccccttgaggacatcagctttggcctcagggtcctaatggcagcagaaccactgacagagctagaggagtccatatgagaccgtggtcaccaccttcttcacgctttgcaaggcaggagggccggaaggatagcctcagcggtcaacgagttcaaagagcctggttacccagcaggttgccccgatctgcgtcaagggatgtgggcgtctcgttggatgagaagtatgaagagcttggcatgtgaatgctaggactcggagtctcaagttcaatgaggtactggagattgattggtggagctggaccaaggaacatcaggaagaagaaagagcctgaatgatcaggaagaagtaaagccgcctggtctgagatggggtgggcagggcagagcttgatcacgggtccgagcagaaccgctaatcttcccgaatataaagcttccgtccttggaacacataagaaacagaggcaagacagacatagaacatagaacacaaaagaagactagagaagagaagtaacaaacatacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47375 - DNA, 3245 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaagccattcaaacccctaccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47376 - DNA, 2997 bp, Homo sapiens
  misc_feature (78)..(78): n is a, c, g, or t
  misc_feature (243)..(244): n is a, c, g, or t
  misc_feature (247)..(247): n is a, c, g, or t
tcctgagtttcttccttttcctctgtcgtggagaactaggctcttttcttacactaaactcagaggcatcagcctctncctgaaggagacggctggttcctgtcagagttgctgagctgcagacaccgacctcaggtggtgcggaggggacatggcagagtggctggtgaagagagcagcctgccagcctttcaatcccagccctgccacttaggagccgtgggcccccggcgaggggggcgnngtncacttaactctccagcctgtttcctttactagccaatgggaatcgtgacagtacctgggtgcagacaggattgaaagtgaattcacacaatgttcttggtgcagagccaataagaggtggccaccggggtgtaggtgttctggggacctgtaatgtcctcacatgtcagcagttgctagtcacattggtctccactgctcacggacagtgaagaccacctggattccctgataaccagcaaggcccccacctagagccaggcagtaatgacctactgggctggatatgcacaccaaagatgatgtgtgcctcaaagcttgcaaacagtaggtgctcaagaaatgccactatgattagcaggactgggatctggagcgctcttcctgcaggagggcattgagcctaagtaacatttgtctttcctctctctgccgtcccccacactcgcctccagggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47377 - DNA, 1877 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcaccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47378 - DNA, 2623 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatgggtatgtaggatgcagggactcggggcggttctatgttcgagaaagcattccgtggagcaagaactggagcgggttcttacaggaagtgagacactttaactgacgtggatgcacggtgggcggggacctgacaggcattagggggcaagaa

SEQ ID NO: 47379 - DNA, 477 bp, Homo sapiens
tcctcgctatgtcatcaaatatttattgagtgggccttctggctggcatggggcgacacaaatgccccctgccaccatcagagagatcccaggccccagggtcttattgccacagtttctgcagtccattggggggcggaagtggccaggggcatgtgggccggggtccaggagcagactccagcctgagtcccctgtgcccatggtacccactctgcccaccaggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtaaagccctgagtgaggatggtgtggggctaaggtgggt

SEQ ID NO: 47380 - DNA, 4622 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47381 - DNA, 4195 bp, Homo sapiens
  misc_feature (4117)..(4117): n is a, c, g, or t
  misc_feature (4148)..(4148): n is a, c, g, or t
  misc_feature (4176)..(4176): n is a, c, g, or t
  misc_feature (4194)..(4194): n is a, c, g, or t
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccagtgttcccatcccagtctctggcctcgtgccgaatttctttgggcctcgagggcaaaatttccctatagttnagttcgtattttaaattggttaattcatgtnattaggttgtttttcccgtgtgaaattngtttttccgtttaaaaant

SEQ ID NO: 47382 - DNA, 4918 bp, Homo sapiens
aggccggtcccacggcaggttgtactcctgcgtgacagagtgagacctccccccaaaaaaaagagagagagaaaaggttgagaaagactgggaagtcaccaaagccagagaatgggagggatctgccctcactgcagggtggtgccaagctgggacttgaccctgaccctgactttcaggactcctgtcccccactccacaggctgcctccactggcaggggactcagaagtgatccggtcacactaagtgacacttagtgatcagaagtgccccggtgccactgagtggccttgtccaagctacatccactctgtgggctcctccttgtagcagcgaggggagggcagatgtcccaggggctggtcactggagcattcctcccctctgactccccagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47383 - DNA, 3167 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47384 - DNA, 3453 bp, Homo sapiens
tcctcgctatgtcatcaaatatttattgagtgggccttctggctggcatggggcgacacaaatgccccctgccaccatcagagagatcccaggccccagggtcttattgccacagtttctgcagtccattggggggcggaagtggccaggggcatgtgggccggggtccaggagcagactccagcctgagtcccctgtgcccatggtacccactctgcccaccaggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47385 - DNA, 2904 bp, Homo sapiens
  misc_feature (40)..(40): n is a, c, g, or t
cttcctcgttgtatcaagtcatggcatctgccatgcgatngtgcacctcagaactgctgagagggcagcgctccccagctccctggctccccacctgccagcccatggggcttgggggtagtgcaggccccagagagaccaagtgcaaaggagtacagctcattgcctctccttcctcctgcagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47386 - DNA, 3415 bp, Homo sapiens
ttcggattggccagggacggtagctgcaggactctgctctcctgcggccatgggccagggttgggctactgcaggacttcccagcctcctcttcctgctgctctgctacgggcaccctctgctggtccctagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcgctgcctgcccaggagctggaggagtacaacaagatcctgttggatatggaaaccacctacagcgtggccactgtgtgccacccgaatggcagctgcctgcagctcgagccagatctgacgaatgtgatggccacatcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccactcagctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47387 - DNA, 1948 bp, Homo sapiens
  misc_feature (66)..(66): n is a, c, g, or t
ggtgagaccaaagaacatctggtgatgtcacagtggacgtcagttcaccaactgggagacacaggnccccgggaagaaaagcaacatgcccagcgtggcctgggagctggggcagagctggccttagaactcagcccctgacaattgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtacttcgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttgagggacatttttatgacttttatgtgtatgtttatgtagaaatttggaaaatacagaaaactgtaaagaaaataaaagccctttatatcaacgtcaagagataa

SEQ ID NO: 47388 - DNA, 2352 bp, Homo sapiens
gccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctggtgggagccacctccccacccccaaacctgagcatgtgcacacacacagagatgctgtcccgctcaccacacagtggggctgccaccacattttaaattgaatatttaaaacaatactcaatttcgggccgggcgcggtggctcacgcctgtaatcccagcactttgggagggggaggcgggcggatcacgaggtcagatcaagaccatcctggctaacacggtgaaaccccatctctagtaaaaatacaaaaattagccgggtgtggtggc

SEQ ID NO: 47389 - DNA, 2825 bp, Homo sapiens
gactggaagaattaactaaaaatacaaaattagccgagtagctgggactacaggcatgcgccaccacgcctgactaatttttgtatttttagtagagatgggatttcattatgttggccagctggtcttgaacttctgagctcaggtgatccacccgccttagcctcccagagtgctaggataacaggcatgagccgccgcgcctggccaaaatagcataatgttttaagaaagtttacgaatttgtcttgggccacattcaaaaccatcatgggccaagggttggacaagctagccttaggtcatgtccagaatgcaatttaacaggaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagaatttcaatatgaaaaagtaaaatctagagagatgacaaatcagcattgggtaccaagcctcaaaatacttgaactagaagccatctcttaaagttaaaagtaagaagctccaggaaaaataaagattgcatagtaaaaagggatagatggcaggattaattcaactcaacaaatatttatcaaatgtctactctggtcaggtgctgtgttagcagccagcttccctaaagggaggaaaggctagacacgaggacattgaggattgtttatttaaagtcactcataggcatgccataatggatttattaaggggaaattggggtttctgtgaatctttacaggacatagccatggagacaatcactatgttaagtaagttgctgttttcccaattgggcttcagtttcctgagacaaaaaagtgaggaagttggattaattgtttcttcaagtcctttccagctctaaagttgtgggttattttacaaaatatccattggtgccacctttcagtgactcttcctatgtttataagaaccaagaaatttaaattttgaagattggaaaaatcacctggtccatctttttccttttcacatctctctctttttttttttttttttttatcatttccccagacaacagaaacagacaaccttccaaatcctctatattgcagttgccttccacacacaggatttaaaaagggggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaacaaaaaaacacta

SEQ ID NO: 47390 - DNA, 2717 bp, Homo sapiens
gactggaagaattaactaaaaatacaaaattagccgagtagctgggactacaggcatgcgccaccacgcctgactaatttttgtatttttagtagagatgggatttcattatgttggccagctggtcttgaacttctgagctcaggtgatccacccgccttagcctcccagagtgctaggataacaggcatgagccgccgcgcctggccaaaatagcataatgttttaagaaagtttacgaatttgtcttgggccacattcaaaaccatcatgggccaagggttggacaagctagccttaggtcatgtccagaatgcaatttaacaggaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagaatttcaatatgaaaaagtaaaatctagagagatgacaaatcagcattgggtaccaagcctcaaaatacttgaactagaagccatctcttaaagttaaaagtaagaagctccaggaaaaataaagattgcatagtaaaaagggatagatggcaggattaattcaactcaacaaatatttatcaaatgtctactctggtcaggtgctgtgttagcagccagcttccctaaagggaggaaaggctagacacgaggacattgaggattgtttatttaaagtcactcataggcatgccataatggatttattaaggggaaattggggtttctgtgaatctttacaggacatagccatggagacaatcactatgttaagtaagttgctgttttcccaattgggcttcagtttcctgagacaaaaaagtgaggaagttggattaattgtttcttcaagtcctttccagctctaaagttgtgggttattttacaaaatatccattggtgccacctttcagtgactcttcctatgtttataagaaccaagaaatttaaattttgaagattggaaaaatcacctggtccatctttttccttttcacatctctctctttttttttttttttttttatcatttccccagacaacagaaacagacaaccttccaaatcctctatattgcagttgccttccacacacaggatttaaaaagggggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggc

SEQ ID NO: 47391 - DNA, 998 bp, Homo sapiens
  misc_feature (998)..(998): n is a, c, g, or t
gactggaagaattaactaaaaatacaaaattagccgagtagctgggactacaggcatgcgccaccacgcctgactaatttttgtatttttagtagagatgggatttcattatgttggccagctggtcttgaacttctgagctcaggtgatccacccgccttagcctcccagagtgctaggataacaggcatgagccgccgcgcctggccaaaatagcataatgttttaagaaagtttacgaatttgtcttgggccacattcaaaaccatcatgggccaagggttggacaagctagccttaggtcatgtccagaatgcaatttaacaggaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagattcaggcaaataacaaaaaataaatcacaaaatatcattgggaatgccctgttcacacatttactactagttccatcaaacaggagacctttagttactn

SEQ ID NO: 47392 - DNA, 1406 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47393 - DNA, 432 bp, Homo sapiens
cagtgcgattgtgatccacgtgcattgtgatccacgtgcattgtgatccacgtgcattgtgatccagtagcattgtgaccaggcctctgtctctgttgtagacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtatggccctgttcatggctccccacctacttcccatctaatcctcagggtcttagacccctccttcaactgtgttgggatctgtttggggtctgtgagatccataaactctgccttaacctattttctttaattggagatagttttgtacctctcctttctcc

SEQ ID NO: 47394 - DNA, 238 bp, Homo sapiens
atgaagagattacatgatttaaaaaataatacgacaaaatagaagaaagtaagacaaaagccaagggagaaacagaattaggaaaaaaaaaaaactcccctctccccactcccggtgctgaggctgcatcagaccctctgtgccaagaggattcatcctgggagagggggcaaggtggaatgcagataactcacatgtaaaaggaacttgggtaggtaaataaaagctatacatgttg

SEQ ID NO: 47395 - DNA, 1682 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacatagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47396 - DNA, 1334 bp, Homo sapiens
cgcgttacagtcacttccggggcggatcggaagttgctttgttttgcttcgagatggctgcggggatgtatttggaacattatctggacaacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47397 - DNA, 2071 bp, Homo sapiens
  misc_feature (27)..(27): n is a, c, g, or t
aattcgcggccgcgtcgaccgcggcgnttcggacctgcgagaagacgacagaggttgaggccaggagtttgagatcagcctggccacatggtgaaaccccatctctactaaaaatacaaaaactagccaggtgtggtggcacgcaccagtaatcccagctacttgggaggctgagacgtgagaatcgtttgaacctgggaggtggaggttgtagtgagcccaaatcatgccacatgtcactgcactccagcctaggcaacagagcaagactctgtctcaaaaaaaaaaaaaaagaagaattaaagaaagtcaactcgagtcatttctgctctccacgtttgatatatttataggatgactagaatgtttctacttctctcattgttaatgttactgtcacaaattcccagtgtgactttagactgcaacatatgttggtagatgggaggtttgctatatgagaagtccttaaaaagagaaagaaaaaagaaagaggaaagaaaaaaaagcagtaattgacaatgggatctctataccgttcacacttacagaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacatagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47398 - DNA, 1574 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaagtgaggagggggcggggctgtgagaggtggggcgaggactgaaagggagaagaagtcagctcttcatctggtggggagtttggcaccaggttggaaagggggagagaagaggacttaacccatctttctgtctccctgccttctggctttctccctcttccctagaagggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47399 - DNA, 1223 bp, Homo sapiens
ggctcactgcaacctctgcctcccaggttcaagtgattctcctgcctcagcctcctgaatagctgggattacaggtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47400 - DNA, 1182 bp, Homo sapiens
ccacgcgtccgtggaacattatctggacagtatgtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47401 - DNA, 1074 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctctgtgccaagaggattcatcctgggagagggggcaaggtggaatgcagataactcacatgtaaaaggaacttgggtaggtaaataaaagctatacatgttg

SEQ ID NO: 47402 - DNA, 948 bp, Homo sapiens
ccacgcgtccgtggaacattatctggacagtatggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47403 - DNA, 964 bp, Homo sapiens
ggagaagccacaaatcatttgccctaccaggatctcctgccacctctgaaagcctcaggctttagcttcccttcctgtagatgacactttctcttcctcttggcatgcagaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47404 - DNA, 1073 bp, Homo sapiens
ccacgcgtccgtggaacattatctggacagtatgtattgaaaaccttccctttgaattacagagaaactttcagctcatgagggacctagaccaaagaacagagggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacgtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47405 - DNA, 493 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtatggccctgttcatggctccccacctacttcccatctaatcctcagggtcttagacccctccttcaactgtgttgggatctgtttggggtctgtgagatccataaactctgccttaacctattttctttaattggagatagttttgtacctctcctttctcc

SEQ ID NO: 47406 - DNA, 633 bp, Homo sapiens
taggatgactagaatgtttctacttctctcattgttaatgttactgtcacaaattcccagtgtgactttagactgcaacatatgttggtagatgggaggtttgctatatgagaagtccttaaaaagagaaagaaaaaagaaagaggaaagaaaaaaaagcagtaattgacaatgggatctctataccgttcacacttacagaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacatagttccctgagaactgcctgccgaatggtgagaaccagattgctttttttgtaatacagttgtaactcttgagttcatgcatggaaagacagttggagattatggaactatatgctttttcagcttcttccaagagcctggaatgaagtggagtataaacagtgtcttcacagatcctcctgg

SEQ ID NO: 47407 - DNA, 1041 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacatagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgcctgttgggggccagtgccctcctaattggggggtaggggctaggctggagtggtaaaaggctcacaaaaatcctgcgaagaaaaaaacttctgaggtaataaataggattatcccgtatcgaaggcctttttggacaggtggtgtgtggtggccttggtatgtgctttctcgtgttacatcgcgccatcattg

SEQ ID NO: 47408 - DNA, 1719 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcgatgtgagaggatggcatgccagaattaggacacgacatgaaaccagagtggtgcctctgtccgagaacttgtaagttctcaacttgggaaagacagaggtgctggagggtgggcctcagaccagggggtctccaaaactttgtaaatcatgcatcttttctccataaaacatctttcacttaatttccaataaatgatgtatttgtgctatacatacgtactgctatactataca

SEQ ID NO: 47409 - DNA, 1217 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatcaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47410 - DNA, 2495 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagagggtatgtatagagtaaaaagtttttgtatctaatgagtgtgtgtaatcatttatttttctacttgatgttaccgtatcatctggtatgatctggagaactgtggcttctctcgctccttttttacgctcttggaattcttaaaacaggataatgatcctcatttctgtgtcagctttttcataacaaatagagtattgtgaaaacgcctcaagaattcaaagatgctgtgttctttatgtcttcctggagaataattagccaggctggctcacacctgtaatcccagcactttgggaggcctaggcgggcaggtaacttgaggccaggagtttgagatcagcctggccacatggtgaaaccccatctctactaaaaatacaaaaactagccaggtgtggtggcacgcaccagtaatcccagctacttgggaggctgagacgtgagaatcgtttgaacctgggaggtggaggttgtagtgagcccaaatcatgccacatgtcactgcactccagcctaggcaacagagcaagactctgtctcaaaaaaaaaaaaaaagaagaattaaagaaagtcaactcgagtcatttctgctctccacgtttgatatatttataggatgactagaatgtttctacttctctcattgttaatgttactgtcacaaattcccagtgtgactttagactgcaacatatgttggtagatgggaggtttgctatatgagaagtccttaaaaagagaaagaaaaaagaaagaggaaagaaaaaaaagcagtaattgacaatgggatctctataccgttcacacttacagaagcattagataccatctccagcctggaacattgagcaaatttggctgcattggggcattcacttggtttcttcaaagatgtctgttggagctattcccatacccactgaaggatctgtagtcttgtcttcattctatgtagccatgttcaaggatgtaacagactggttttgagatacatgaagctgtgtcttaagttactctgagtttacacatgaaaaggtgaacatcatcaaaaaccctggacatagttccctgagaactgcctgccgaatgacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 47411 - DNA, 1504 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccaacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcgatgtgagaggatggcatgccagaattaggacacgacatgaaaccagagtggtgcctctgtccgagaacttgtaagttctcaacttgggaaagacagaggtgctggagggtgggcctcagaccagggggtctccaaaactttgtaaatcatgcatcttttctccataaaacatctttcacttaatttccaataaatgatgtatttgtgctatacatacgtactgctatactataca

SEQ ID NO: 47412 - DNA, 765 bp, Homo sapiens
cgcgttacagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgcctgttgggggccagtgccctcctaattggggggtaggggctaggctggagtggtaaaaggctcacaaaaatcctgcgaagaaaaaaacttctgaggtaataaataggattatcccgtatcgaaggcctttttggacaggtggtgtgtggtggccttggtatgtgctttctcgtgttacatcgcgccatcattg

SEQ ID NO: 47413 - DNA, 719 bp, Homo sapiens
tgtgccagtttaagggctacccacaggcatctctatgctttgccatttgcccctgtaaggagtaaggtcgggagtcctggagaagtcaagctcaagtcgtcctttgtaacgacactaaagctcaccttgagttcacttcacacgggccagtcacaaccacttaattctgtcctcacagcccatcagcaggcactgtggtgtttctatcttacggaggaggacgccagggcttgcccaacgctatcaccttgccagagtcgtgctgctgaattatggcagatctggggtgctgtcgtgggtgtctctgtctccctcccacatcccggtctctacccaccatactccctggaagtggagagcaatcacagatctgctggtttctttctctgcacctggcaacctctggagggcaaggcctgcacttttccagctgtgacaccagcccatgtgtctcatatcatttctctctcatgtagcaagaatttctccccagaaaggaggtggcaaagatgggcagggggtgcaaaggtgggggctctgacagccaggttccagggtgcactgctgagccagcccacaaccatggtgaggcagggagattccgcaggactccgtatccgtgctttgaagatggctttcgtgcttttagtcttttctttgttcatttgttgtttgttttctgatgatgttttagtaaaaagttcttttgaaaatcccaa

SEQ ID NO: 47414 - DNA, 534 bp, Homo sapiens
cttatctactcagtcattgtgtttctttgttgtttttatatgtactttgtgttaagacatgttcagggtcctttctattcaaactgtacaaattgtttgaaactagcaccctggttttttccttctttcctgtccacgatggtccttgtccagtgcatgcacactgcaggccctgaatcaacgcaggcgactggcccacaggtggactgacgggctcactaggatgctgggcagcgtgtctggctggtttctagctagggctctgtttcctgtgtgcccagagaaataaaggggaaaaagcacacccactcacacacacagtcagttcctaactaaatgccacaagcgagtgactggtggcaggaaaatagaccctttgctgtgttttaggcccctttctgtcctgggtttttgtttgtgtggtagtgatggttgatcttaaatcatgtaaaaagtttgttttcaccaaaataactcagaccttttgcttctaaagaagggagagaaaagggggccagaaaggaaaaaaaaaaa

SEQ ID NO: 47415 - DNA, 378 bp, Homo sapiens
tatttactgctgccaaactgtcatctttgctgttccaggaacttgctaagcatgcctctacctcaggactttcgcatttctgttccctttgcctctaatttcagatatccacgtggtttattccctcatcttcttcaggtatttgcttaaatgtcatcttctttgtgaggactctctttcctaattttagatgaaacagccctgtggttcttcatattctcctttcctgctgtatttcctctccatagcatttatcacctgatacaccatacagattatttatttactttgcatttccccccaatagcaatgtgaactccacaagggcaggaatttttgtctgtttactactgcattactggtgccttgtacagtccc

SEQ ID NO: 47416 - DNA, 205 bp, Homo sapiens
aggggtggccaggacccccgctgcttgtgtgggatggaaaaaccaaagctgccgaccacatagaggcggggtcgggaagctgggggcgtcaaataaagtcatgtggagggccgaggatggtttttgctgacatggaagcaccttcttcaaaaagagcaacaggaagatacaaagagctctcgtctctcaaaatagactctaagtg

SEQ ID NO: 47417 - DNA, 341 bp, Homo sapiens
aggagcctctgtaaaagggaattgaggtgcctcttgccaacagccagtacaaatatgccaaccctgtgagtgagtgtgatgggttcaactgtgtcccccaaaactcctatattgaagtcctagcccccagactttcacggtgtgacagtatctgaagatagggtctttaaaaaggtaattaagtttaagtgaggtctttcaggtaggcccaaatctgatatgactgggtgtccttataagagggagcctgggcaacatgggcaagaccccatcactcccaaaaaaattttttaaaaattagccacatgttgtgggtacacgcctacagtcccaactactct

SEQ ID NO: 47418 - DNA, 394 bp, Homo sapiens
gcgagatagcaccgctgcactctggcctgggcgacaaagtgagaccctgtctcaacaaaataaaataaaaccaaaaaacaacccccatagaagacacaaatttcaattcccatctctggattgctcagactacacatgggcatatatggaaagcttcaacattcatttcatttatcaacttatttagaaaggcacattgtatctacccactggggtgtggtacattccagggttcaagtccctggtttataatccaaaacctgtcctggccctccacatgcgtgggtgctcagaaactccgagcgcctcagaggtattctcttaacatctgatcaaataatgactataaagaataatatgcagtacatactgtagatagttccctgtgcacata

SEQ ID NO: 47419 - DNA, 491 bp, Homo sapiens
ctgggttgtgtctgtctctgtggtcccaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgag

SEQ ID NO: 47420 - DNA, 368 bp, Homo sapiens
  misc_feature (263)..(263): n is a, c, g, or t
  misc_feature (342)..(342): n is a, c, g, or t
ctgggagcagactattattgcaaagatgacaagataccaaaaacagagaaaggctgttttgtaaggttacagtttaaaaaagaatcatggaagaaataaattggctactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgcnccgttaagagtcatcaccactccctaatccttaaggacccaggggacacaaacactgcggaaggccaaggcgcaagggnccctctgccctagggaaaaccagaga

SEQ ID NO: 47421 - DNA, 338 bp, Homo sapiens
tctttattaacttatatctcattttcttcctattaaaattaaaatattcttcttcctttgttgtctgattaaaaattctgctcactgttcaaaaatacaggttaaataccatatctttgtaaaacccttcttaacctcctcccctgtcctcagtcccgccaccaacacacgcacatacttccttttcttttgccagtcagaattatttactatcttttctgggcccacctaattttatatacttctattaaaatacattgtattttatttagtactgtagtatgtttgtgtcttccactatattgtgatattcttccacgatatcaccatatagtgga

SEQ ID NO: 47422 - DNA, 494 bp, Homo sapiens
aaataagcagctttcacacattgttgatagaaatgtgaattgatagactctttatgtaggtcattttatcagcctttactaaatgttaagccattctacttctaggaatctgccctacgaaaatgtttgtagaaatgtacaaaaatctcttacatgggtattcatttgtagtgtataaagtagttaaaaaaattacaaataacccaaatgattatcaatagaagattggttaaatcacaatatattagaggattctggggagatggcagagtaggcagcaccaggaatctatctccctacctcaacaacaattgcattggcagaatctatctgatgtaactattttggaactctggagtctattcaactcttgcagcttctacagtaggggtgtccagtgttttggcttccctgagtcacattggaagaagaactgtcttgggccacacataaaatacactaacactatgatagctgatgagctaaaaaaaaaa

SEQ ID NO: 47423 - DNA, 172 bp, Homo sapiens
gttgccttaaccttctacaagggaatatgtgggccgtgtgtattttaagtaggtaatattgtgaaatgacactgggcagaatttttattttccggatcttttttgattcaagatcttttttgttattccctcaatacaatttttgggtgaccgctagattggtaaattggca

SEQ ID NO: 47424 - DNA, 382 bp, Homo sapiens
gggagtgagcatgaacaagtaagagacctttcctgcaagactcatacagatggtgcctcagcatatctgggaaggagattcaagcacaagctagccaaaacctgccagacatccagcatggtgcttttcaatcagcagcccccagacgtgagtgaatacctctgtgcggtcaatcagacttcattgtcccttctctgggctgacctggagtcagttgtttacaccttgcagtacctgacagcttcactctgtctttgcctcaatcctgggggatccgtaatagccactgctagacctgttttaatgtggccaaggagacaactccttaggcaaacgaagcctcaaaaagtttagatcaaaaagaaaaaggtcctgcaacatt

SEQ ID NO: 47425 - DNA, 1248 bp, Homo sapiens
atcaattacagtggttgcagacatcatgagtactcctttggcacagagctcggtcttttacttcctgcccctaattgacccctgacctggacatatctgtctttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaaatgtctgtcatgggggtggggagcaggggaagcctgggatgcaatgagggtgggaggggaagaaaaaggagtagtacattcatgctgtggaggcaggagtattaccaatttgctagaaagagtactgttctggaaactgacttttttccaggtgccctgcactcattccagggtttagtttagagttagacttacaatgggctgggcgtggtggctcacgcctgtaatcccagcactttgggaggccaaagcgggtggatcacgaggtcaggagatcgagaccagcctggccaacatggtgaaaccccgtctctactaaaaatacaaaaattagccaggcgtgatggtgtgctcctgtaattccagctacttgggaggctgaggcaggagaatcgcttgaacccaggaggtagaggatgcagtgagccaagattgtgccactgcactccagcctgggcgacagagggagactccatctaaaaaaataaaaaaaataaaaaaagttagacttaccatgttgtcccccctttccaactaatctttaacataccccacccaagtttttctctccttacccttactccactttttggccacacctgccacttctgacctcataatccct

SEQ ID NO: 47426 - DNA, 1502 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47427 - DNA, 623 bp, Homo sapiens
atcaattacagtggttgcagacatcatgagtactcctttggcacagagctcggtcttttacttcctgcccctaattgacccctgacctggacatatctgtctttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47428 - DNA, 392 bp, Homo sapiens
ccaacaccccatacctttgctataggtagcatttgcccttgatccggagtagatttgccaaaccattagaacaactgctgacctgtatagaaattcttatggtctgaaattaataatggtggaactttctcaggactgttaggaaaagtatcttttggcttttctttttatgtgttctctaagaagccatcatacattgtgcctcagcctctgcaacccctgaacctgctttgggtattcatagcccactcttgactaatgcttacctctgtctttgcatgcaccggggggattcttcctccctccctctttccctcccttcctctttccatctaccctccgattgttcctgaaccgatgagaaataaagtttctgttgataatcatcaaaa

SEQ ID NO: 47429 - DNA, 1892 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaagaaaaaagaaaaaaaaaagaaaaaaaatgaaaaaaaaaaaaaaaaaaataaaaaaaaaaaaaaaaaaaaaaaaaaaaaaaaacccttgtgggccgcttggcccaagtggattttagcttggggcaggtttatgcttgggcccgaatttggggctaatttgcccaattcgccctatggggggccgattaccattcaatggccgggggtttaaaacggggggactgggaaaaccctgggggttcccaaatttaatggccttggagaaaatcccctttttcgcaggtgggggtaatacagaaagcccccccccatcgcctttccaacagtgcgcaccctatggcgaagggaatttgaggcgtattttttgttaaaatcccggtaaattttgtt

SEQ ID NO: 47430 - DNA, 1430 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47431 - DNA, 1127 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcccggagtggtgtgtttaagggtactggttgaaagtcttttagccagaacttcagtttaaccgaacttctgccttctgtaagtggaggaatttcccccccaaaaagggtaggtgggccccctttatgggtgagagggtgct

SEQ ID NO: 47432 - DNA, 1875 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctggtgggaaatctgggactggagggggctggtgagaagggtggctgtgggaaggggccgtacagagatctggtgcctgccactggccattacaatcatgtgggcagaattgaaaagtggagtgggaagggcaagggggagggttccctgcctcacgctacttcttctttctttcttgtttgttgtttctttctttcttttgaggcagggtctcactatgttgcctaggctggtctcaaactcctggcctctagtgatcctcctgcctcagcctttcaaagcaccaggattacagacatgagccaccgtgcttggcctcctccttctgaccatcatttctctttccctccctgccttcattttctccccaatctagatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47433 - DNA, 1140 bp, Homo sapiens
gtgaagatggctttggaaccagctggatctaggctgtgccacatactacctctttggccttggccacatccctaaactcttggattctgtttcctaagatgtaagatggaggtaattgttcctgcctcacaggagctgttgtgaggattaaacagagagtatgtctttagcgcggtgcctggcaccagtgcctggcatgtagtaggggcacaacaaatataaggtccactttgcttttcttttttctatagagaatcctttcctgtttgcattggaagccgtggttatctctgttggctccatgggattgattatcagccttctctgtgtgtatttctggctggaacggtgagatttggagaagcccagaaaaatgaggggaacggtagctgacaatagcagaggagggttttgcagggtctttaggagtaaaggatgagacagtaagtaatgagagattacccaagagggtttggtgatggaaggaagccacaggcacagagaacacagaatcactttatttcatatgggacaactgggagaagggtgataagacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47434 - DNA, 548 bp, Homo sapiens
atgtctcggtggatgacacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47435 - DNA, 833 bp, Homo sapiens
cacccgagggaatgaagagcaagcgccatgttgaagccatcattaccattcacatccctcttattcctgcagctgcccctgctgggagtggggctgaacacgacaattctgacgcccaatgggaatgaagacaccacagctggtgggaaatctgggactggagggggctggtgagaagggtggctgtgggaaggggccgtacagagatctggtgcctgccactggccattacaatcatgtgggcagaattgaaaagtggagtgggaagggcaagggggagggttccctgcctcacgctacttcttctttctttcttgtttgttgtttctttctttcttttgaggcagggtctcactatgttgcctaggctggtctcaaactcctggcctctagtgatcctcctgcctcagcctttcaaagcaccaggattacagacatgagccaccgtgcttggcctcctccttctgaccatcatttctctttccctccctgccttcattttctccccaatctagatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtatgagaagggacgagggggaggggatgaagaagaggtgggttggatcagagaccaagagagagggtagcaagtctcccaggtaccccactgttttctcctggggtaagtcataagtcggttgaggggagatgaggctaggctctggatatctgcagtaccca

SEQ ID NO: 47436 - DNA, 2127 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaaatgtctgtcatgggggtggggagcaggggaagcctgggatgcaatgagggtgggaggggaagaaaaaggagtagtacattcatgctgtggaggcaggagtattaccaatttgctagaaagagtactgttctggaaactgacttttttccaggtgccctgcactcattccagggtttagtttagagttagacttacaatgggctgggcgtggtggctcacgcctgtaatcccagcactttgggaggccaaagcgggtggatcacgaggtcaggagatcgagaccagcctggccaacatggtgaaaccccgtctctactaaaaatacaaaaattagccaggcgtgatggtgtgctcctgtaattccagctacttgggaggctgaggcaggagaatcgcttgaacccaggaggtagaggatgcagtgagccaagattgtgccactgcactccagcctgggcgacagagggagactccatctaaaaaaataaaaaaaataaaaaaagttagacttaccatgttgtcccccctttccaactaatctttaacataccccacccaagtttttctctccttacccttactccactttttggccacacctgccacttctgacctcataatccct

SEQ ID NO: 47437 - DNA, 1369 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcacctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47438 - DNA, 1472 bp, Homo sapiens
aagagtggtatcaacgcagagtggccattacgtccggggagtctcaacagggacccagctcaggcagcagctaaggctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47439 - DNA, 1530 bp, Homo sapiens
gtgagggacccaggttcctgacacagacagactacacccgagggaatgaagagcaagcgccatgttgaagccatcattaccattcacatccctcttattcctgcagctgcccctgctgggagtggggctgaacacgacaattctgacgcccaatgggaatgaagacaccacagctggtgggaaatctgggactggagggggctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaa

SEQ ID NO: 47440 - DNA, 4084 bp, Homo sapiens
  misc_feature (19)..(19): n is a, c, g, or t
  misc_feature (24)..(25): n is a, c, g, or t
aattatctttgcagacttnaacannaaagtcaaagaccataagtgtaaggttttatttctgaattcttgaatctatcccatttatctgtctgcaaggaacccacgcgtgggttccttgcaggcttagagagaaggtgcaagagctgtctgaaaaggtcagagcaaagcatgaagctggtgagcagctgtgaccatagctggaagcttctctctgagctttctcctggttacctcctcctcccctacgtgaccagtcagccaagtgttaagtccaggggaacattttgctgcttccaagtactgtctcactagtgttatttgccataacttgcggccacagggcaaggtccaggtgctcagacctttacatcctggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggccccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggtgaagctctttatcctgcttatggtcacacactttgacttagagttggtggaccctgacacaccactaccccatgttgacccgcagcgctggggttttggcaccatgcagcccagccacgatgtgcgcttccgctaccgcctgcatcctacagagtgagcttggccaagccagctgcaaacctggccagaggagttctattgcatctctcacctgttctcacccctctgcagccccaagaccccactggccacccctccctctggtcctgtggcaccccctacctctgttctgcctgtcctcgctctctccccgcctagtcatctgacaggcttatcattctctttaaaataccatctctcagagtgggttctgccgaaccctcctctcacaggaagtccagaggaagggggagtatctgtgggcaacttggtttgggagatgatgcctgccttgagaagtcctgagtacagagactggttccccccagacacgagtaacatggcatcttgcaaacatcagcctccactctcccagcttgctttagttttttcagcaacacttatcccacatcctatggaattcaggttctagaacagtgtcatccaacataaatatgaagcaagctacatgagtagtggggttttttggttttgtttgtttgttttgagacagagtcttgctctgtcgccgaggctgcagtgcagcggtgcgatctctgctcactgcaacctctgcctcctgggtttaagcaattctcctgcctcagcctccccagtagctgggattacaggcacctaccaccttgcccagctaatttagtttcctggtaaacacatttttaaaaagtaaaatgaaacaattcatttttataatatactttacttaatccaatatatccaaaatattggcatttcaacgtgatcactattaaaaattttaacgtaatagtttttaccttccctttttcatcctgtcttcaaagtctggtatgtactgtacttttgcagttcttcccagttcagactagccacattccaagtgcttaattgccgtgtgtggcaggtggctgccctattggatagcacaggtctagagaaatgatacctttttttttttttgagacagagtctcactctgttgcccaggctgcagtgcagtggtgtgatcttggctcactacaacctctgcctcccgggttcaagtaattctcctgcctcaggcttctgagtagctgggattataggtgcgcaccaccacacccggctagtttctgtatttttagtagagacggcgtttcaccattttggccggcctcctcggcctcccaaagttctgggattacaggcatgagccactgtgcccagtcaggatgtctttaatgtaggaatcattcaagatccctcctcagtgcccatgtctcccccacctcagggtgctgtcaaccctcccttggtttccatgatcattgctgaactcagagctttcttctatccccagacccacatgggagtctcccagcacctctgactcagcttggccaatgcagaacttggcatctgaacccctgcctcttccctgaaccactcctcctcctgatttccctgctctctctgctcagaacactaccattcaccccatctcccagagacactctccctcctcctctttcaccttcatacaagcaggcccccgtcctatcagtacacccccctgtgatgcctctgaaatatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttagtctccaaacttctcaactttgccagctttctccaatgaaaccatcagtagagacattgctgttcctgcccatcccagtgccagctactccttcctggaagccttcctggatttcacgcatcccatcctctggccagaaatggcctccgaactgtgcagctcctgcagcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctgaaaac

SEQ ID NO: 47441 - DNA, 282 bp, Homo sapiens
ctggactcttgcgtaaccttcaaacaatcctccctgcctccagtctgcacacggcaggcttccgggatgacctctgaacagaacgcgtccccattcccacacctaccaagcatggcgtttcaaagtgtctccagctctgccctccccagggcccattttctggttcaacactcatgccaagccaaccgccccatcctcgttccttgccccaaactctgcaggctgggctcatcatgcttgctcctagcttcaccagccctgttgccctcactgccaggcaag

SEQ ID NO: 47442 - DNA, 602 bp, Homo sapiens
attccttaggttgaaatgacttttattggagttttttggtttgtttggtttttttttcacatttctgaagtgcttgtttgtgtaccttgtgttactctgttattccactggtcttactctaaatcagaataattttctgtattgatttcctaaccactaaaaagactgcaattcccataagcacttaaagtagttctgcaagcttgtactttcactccacctatactttgtccccaagtgaacaagtatttgttaaaaactacatgttctgattttgataatgatactacaataataacagaatgactctgattttaggatatatagcctgaaatattataaagaggcattatgtctgcaacttattctcatgttattcagaaaaaaataacatgcatgtatacatatatatagagaaaaaaacatggtaaatgtaataaacatttggcaaatctggatgaaggatatatagaagttctttgtactgtatctttaagtatgaaattatttctaactttaacaagcacgaatgattcattaaaatgtatgacccttagctctctttcacaaccacagcaatcttgagaaggtggtcctctccc

SEQ ID NO: 47443 - DNA, 346 bp, Homo sapiens
cattttggccaggctggtctcgaattcctgacctcaagtgatccacctgccttggtctcccaagtgattccaggtggaaatctcccaagtgattacaggtgtgagccactgtgcctagccaggagctggcatttgaacaaagccctgacggaggtgagggagttctggggatgtctgcagggaagggtattttaagtaaagggaacagccagtgcaaggccctgagacaggagtgtgtccggtaagtctgaggagcttcagggagctagagtgttgagaggggaggaagcagagaagagagcgctaggagatgagggcagagaggcgatggggcagatctgtcagg

SEQ ID NO: 47444 - DNA, 800 bp, Homo sapiens
cagtgaaagcaaatactcagcaaaaaccatgtgccaggctctcttctaagcactttacatattaacccattgatccttataacaccttaggaaatggtaaaagactagtggttggaagacaaaatgacttctccttgccatacccagcagaaaaagaaaatatgtttgtagaccctctttcaactaacagagatgggtaatcttttttaaaaagagaaagttgagctagttgagatatgtgcagggtggtctggggagacagagaaatctgagagtttgtggggcagtgtgaggctacagggtatgttggaaccactggagtcccatctgggtcctgggctacaatgatgccaaagatcaagagggactcttaaagccgagccctagcaaagaaccagggatattcagagtggaggcaagacagagaagggtgttgaagccaggtctgcaacggagaattgccttaaggtcatttggaaccaggccgaaaagtttcaccagctagggtgaacctaaagttatatcagccaggcgcagtggcttatgcctataatcccaacacttggggaggccaaagtgggaagcccaggagttcaagaccagccttgccaacatagcgagaccatgtccctacaaaaatgtgaaaattaggcaggcgtgatggcacgtgcctgtagtcccagctacttgggaggctgaagtgggaggatcacctgagcctgggaggttgaggctgccatgagccatagtcacgccactgcattctagcctggacaacagagcaagaccttgtcttaaaa

SEQ ID NO: 47445 - DNA, 890 bp, Homo sapiens
acatcttcctcttttgacatagcaaggcatggattctgtcaggttcatctttatagcctctgaccctggcccagaggtgcctaggaaacatttaaagagtaaataattgattctcaaagataagcctttccacctcggtcaccacccaatccatgtgcgcagaactcagaaggaggagccaggttggattgtcatgtacaaacagcatctgctgtggtctagtccctttgtctcccaaatctctttgcttctgttctgctgtgtttcagggcaggaaatagaaatcagtctagatattttattttttaatttaatttaatttttttttttgagacagagtctcactctgtcgcccaggctggaatgtagtggcaccgtctggctcctctgcctcctgggttcaagcgattctcctgcctcagccttctaagtagctgggattacaggtgcccgccatcacgcccagccaatttttgtatttttagtagagacagggtttcaccatgttggccaggctggtctcgaactcctgacctcaggtgatctgcccgccacggcctcccaaaatgctaggattacaggcataagccaccgtgtccagcaccagtctaggtattttaagcagaaagatatttactagagggaattttgtgcttatagaggcataagggggctggaggaatggggctccaggaatgtctcccagctaatggtagtagtttatataataattaataaacaaacgtatgttggcatggctgttcaaaaaaacacctctcttctcaaacaaaacatgtcggccgcttggcccagtcgctttagattcggcaagtttatgatgcggcccgaattgagctacttggccacttgcccttatggggccgatttcc

SEQ ID NO: 47446 - DNA, 1400 bp, Homo sapiens
gtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatggctcattgcagcctctaactccggggctcgggcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagcctgggtgacaagagtgagactctgtctccaaaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaaaggaatcgaagtgattgtttgaaagggagaggaagaaagagagagggagggagggaagaatggagggaggcagggaaggagacagagagagtagaatccagccaccggaaaatccagaatagctggctttgcttaatccatgcctggaaataactgctgggtttgcaacaacttctctcccggagacagaccaaggaaactacaaaactgcaggaaggattgaagggccgggcacagtggctca

SEQ ID NO: 47447 - DNA, 2771 bp, Homo sapiens
gtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatggctcattgcagcctctaactccggggctcgggcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagcctcactttgttgcccaggctggagtgcagtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgcctgtggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgcaactatccttatcagagacttggcggggggcagggtatgatggagatcataaggaggctaaaacactccacaccctccctctgcattgctcctgcacgggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcggtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtgatcccagctactcggaaggctgaggtgggagaatcccttgagcccgggaagtggaggctggagtaaaccatgatcgagttactgcactccagcctgggtgacaagagtgagactctgtctccaaaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaaaggaatcgaagtgattgtttgaaagggagaggaagaaagagagagggagggagggaagaatggagggaggcagggaaggagacagagagagtagaatccagccaccggaaaatccagaatagctggctttgcttaatccatgcctggaaataactgctgggtttgcaacaacttctctcccggagacagaccaaggaaactacaaaactgcaggaaggattgaagggccgggcacagtggctca

SEQ ID NO: 47448 - DNA, 715 bp, Homo sapiens
agacgctgctgggtgaggtttctgctgctggatgcggtttctcgttcctacaaaggctcacccaggtagggatgggcagcttctctgggtctgagtctggatgtgatgcctggaatgcagcagccatcttggcaccagagggtgatgccaatatgtggaggaaagcagaacaaacagcagagcagcagaactgggcctgcatgctgtgcccggagtagagccaggcaatccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaaaggaatcgaagtgattgtttgaaagggagaggaagaaagagagagggagggagggaagaatggagggaggcagggaaggagacagagagagtagaatccagccaccggaaaatccagaatagctggctttgcttaatccatgcctggaaataactgctgggtttgcaacaacttctctcccggagacagaccaaggaaactacaaaactgcaggaaggattgaagggccgggcacagtggctca

SEQ ID NO: 47449 - DNA, 418 bp, Homo sapiens
gaggccctataagggatactttcgtttttcactagtggtgtcttagagagttgtttcatgcataatttattggatgagtatcatttgttccctaaaggatgctaggttatatttttgaattttgtcaacaaagcaatttttatgaagctgaagatcatatttttcacatttactttgacatatccgtgactcagattgcggaaacaggcctgaacccccagtgcttcttagctcagtaacagtggtgataattttgggtgcttgctctatgcctgatactgttccaagcactttccatgcctcagcctcacagcaaacccggagtaggttctattattagctccattttgcatcagaggagaaaactgccccaggtcaaatagctggtgtgtggggtggagctgggtttgagcccagg

SEQ ID NO: 47450 - DNA, 410 bp, Homo sapiens
gtaacttgctcctcaccttccaccgtgattgtgaggcctccccagccatgtggaactattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaaggcactgagtt

SEQ ID NO: 47451 - DNA, 3599 bp, Homo sapiens
  misc_feature (1349)..(1349): n is a, c, g, or t
  misc_feature (2088)..(2088): n is a, c, g, or t
gctagaatgcactgtctttgaagcattgagcaggccctcaccagacaccaaatctgctggttcctggatcttggacttcccagcctcataactaggcatcacaaatctccgagaggaacgcatccacttcctggcctggtagagcggagagcagaggtgggcccaggagtccaagaacttcccctaaggctgctagtcgcacccatctcttgagcagagacccaagagggcaggacaggaagaatggaagtgagatttggccccggtcatgttttccaaagtgctgacatcaggaaaataatagaagttaacgcagatatggggctgccactgaggagagagaagactgaaagaagcatatagataaaagtttcagttacctgaggtcaaccttggtctgaaattagattatctgagtaggctgaaccatcggtgaaaaggaggccaagcatctcaaaaataggacacgtgagagtatggagccaatgtgacactcaggtgagttagccttatgatccctaagcatgcagtccttggaccagatgcatcaggatcttctggtaagtgtgctaaaatataggctactgagacccaccctatgtctgtcaaatcagaatattctaaggaagcaggtcccagggaatatatattttaaagctccctaaatacacttcatgggctgccagatttgggaatcgcaggattaggtagctacctaaatgaagacacttaaatgtgccaaaagcttctctttcacccatccatttatccatctattcacccatccatcaaccaaacatgtgccagtatctggtatttgcttcatgacctgctactgctgtggtgggtgcaaagataaatgatcaatgttctcaaagagtcaatagtctaagagaatggatgaatgaagtataaataataaaagatgtgctatgaagtacgatgggggtccagaaaagtatatacttattccagattgtggcagaagactctggagaggtttcgttttatataatggcatgaattccccttcagatccatctctaaatcaagcttcacctacttctgactgtttgtgttagataccaatcctatggatttctatagttttctggaattactttttacacactacagtagagttatgtggctgcttccatgttttacttagaagctgagagcttgataaaagtgaaggctgcatcttaatcatcaccttttcccccacctcctagctagggtctggctctgcctaagcagctgccattggtgctcaataaacattgaagaagttgggttgttgcactggttatgcaaagaaagggacacagtgggtgtaagcgtggggnggggagcaaagctgggaccaatcatggaacacctagaatttgaatcaaatttgggctttagtttttaggcaatgagcctaagacaattttggaagcatcctttgttcacaaaaaagttagaaatggtgagaactagggcagtctatcacaaagtgtgggagaggtaattttatatgtaaactattataaatcacatttgagttatgaagtgagacaattattccctttgcagtttcatttcattctgtctaattatttcagggagacattctgaattgggtgctagtattttaacacttctctaacactttctctttttaaattttgtttatttttaattgacaaataataattgtgtatatttatggggtacattgggcatggagggtgggttattctgtgatgtcttgacctgtgtgtacattgtaacacttctctaatactttctaatccagccatccccaacctttttggcaccaggaaccagttttgtggaagacgatttttccacagatggttgggggatgattttgggatggaactattccacctcagatcatcaggcattagattctcataagaagcatgcaacgtagatccctcacatatacagttcacaatagggttcatggttctatgagaatctaatgctgccactgatctaacaggaggcagagctcagctgataatgctttttcacctgctactgacttcctgctgtgttgcccagttcctaacnggccatagactggtaccagtccatagcctggggcttgaggacccctgctctatgatgtctatacaacaataaaattgcctaatgatacatttctcagaatgtatacccatcattaagtgacacatggctgcttgtgtatttttatatatagctaaatgtggctagattagatgtgatatctctttggatgcagggataggtgggcaagtttctaaaacacgaaactaactgtgtcttttctctgcttaagaaccttccatgactccctgttgttcataaccggataaattctaagctgcctaactcagaattctagcttagagatgtctacgcctggctgctcccaacagttagtctcatgtcctgtctcaaacatggggcttcagtaagaatgaaatttccaaggagaattttatattctgcatgcctttaaaggctcaagcctggagaccccccttcttgcctctcttacccttttcaccagggcaccctctattcatccttccagagccttctctgggaagtcctttcccaaagcccacttcccagcctaagcttagtgctatttctgtagatacccagaaacacatcaactatatgtacagtttaccctagtatgtcaaagttatagttactgccttaggagggattttgagcttttcatctttattactcgggcttctgctactgtgtcaagcaggtagttgacactcaacaaatgtttgtttagcctaactcagcagaacacatggagtgtgttcacatggagtaacctgattttgcttagtctgcaacatttcttgcatgcatcccctgcttgcagtctcaattacagtcatcctgtttcagttttcttaacttgtcactcccttcctctgataacttttgccatacctctgtataacatggcctactttttgaaaaagatttttttacattcacctacatttgtctcaaatttttttttaaaagaaactttgtattactaccgtcattgaaaaccttcatcacttggcacaaaagaaagtttaaaaaatacaacaaaagacattctactaaattctggctagacaaccttgcctgctctagtagatgcactgagaccattaatgaatctttcatcccaccttgtgtcatattctttgccacatgactttgggtctccctcactactaggcaagttcctgtctccatctcttgattctgaattcagccataatacttgctctccccaatgttgttttagcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaaggcactgagtt

SEQ ID NO: 47452 - DNA, 487 bp, Homo sapiens
accccatgactggtatagaactgaaagtaaatcaagctggacttatgaaggattcctctctccattcgtggatgaatttgagtggcactggaacaagtttcagttacctgaggtcaaccttggtctgaaattagattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaaggcactgagtt

SEQ ID NO: 47453 - DNA, 723 bp, Homo sapiens
gctagaatgcactgtctttgaagcattgagcaggccctcaccagacaccaaatctgctggttcctggatcttggacttcccagcctcataactaggcatcacaaatctccgagaggaacgcatccacttcctggcctggtagagcggagagcagaggtgggcccaggagtccaagaacttcccctaaggctgctagtcgcacccatctcttgagcagagacccaagagggcaggacaggaagaatggaagtgagatttggccccggtcatgttttccaaagtgctgacatcaggaaaataatagaagttaacgcagatatggggctgccactgaggagagagaagactgaaagaagcatatagataaaagattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaaggcactgagtt

SEQ ID NO: 47454 - DNA, 501 bp, Homo sapiens
gtggcgcacacctgtaatcccagctactcggaggctgaggcaggagaattggttggccccaggaggcagaggttgcagtgagccaagatcacaccattgcactccagcctgggcgacaagagtaaaactcagtctcaaaacaaaaacaaaaacaaaaacaaaacaaaacaaaacaaaaaaatacactatgtcaagttattaggtaacccataacatcctttgttttaacatagccttgccaagggccgggcacagtggctcacgcctgtaatcctaacactttgggaggctgaggcgggcagatcacttgaggtcaggagttcgagaccagtctggccaatatggtgagaccctgtctctactaaaaataaaaaaattagccaggcgtggtggtgggtgcgtgtagtcccatctacttgggtagctgaggaacgagaattgcttgaacctgggaggtggaggttgcagtgagctgagtgagatcatgccactgcactccag

SEQ ID NO: 47455 - DNA, 357 bp, Homo sapiens
agagatggggtttcatcaagttggccaggatggtctcactctcctgaccttgtgatccacctgcttcggcctcccaaagtgctgggattaaaggtgtgagccaccgtgcctggccaataacaaccattatataatttttaaatgtccttaattaataagactttgttaagtaccatttggccagtttatacttctccccagcaagagcaagaacagaagaacaccttaatcagatttgttttttgtgggcttttgttgagagggagtctctctctgtcacccaggctggaatgcagtggcacgatctctgctcactgcaacctctgcctcccagatttgagcgattctcctgcctca

SEQ ID NO: 47456 - DNA, 867 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaggtttttctacttgaaggacactgttttccctagcacatttgcagggtt

SEQ ID NO: 47457 - DNA, 809 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgga

SEQ ID NO: 47458 - DNA, 555 bp, Homo sapiens
aggctcgggcctggtgggctaatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgga

SEQ ID NO: 47459 - DNA, 1379 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaagtcaagtgagtatggaggctgagaggcagcatatggcacttcatgctggaaagcttcacaagcagtagctgcagtggtggcattgccccagggagctgtaaatgtttaactagaattactttttccatgagatctttccacctgatttaagggagagatcactgggcagtttgagactgaacccacgtcttaggggaaggaaggtcactcttctgtcctctacccacaagaacatactgtaactctactgcttttcccatccccagagagagggagggagagagaggtggatgaagggtgaaagacaagcagtcttcattcttttaactttccctggtacctgcctatacaggtctagggtggggtctggaggggatcctaacttagtcaagtggatcactgaccttgcagtttcctcattaactgatggcaggaagccagagggctgggcagcttccacccctgcctcccattgtgaaaagaaagtcccttttaaatcctcccctgcctcaccccacaagtctttgctcccccaattcctaaggcatggcatatggattcacggcatt

SEQ ID NO: 47460 - DNA, 1191 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaactcgaggacgccgcgtgtacccggttgtcctcaggcgctgtcagatctgtggtttttctacttgaaggacacaatgttttccaaactagcacatttgcagaggtttgctgtacttaatcggggagttcattcttcagggcttctggtacatcttgtgcaactaaaaaaacaagtcaaggcccttccacctttgatgacatttttgtaagggaatctaagtttgtgcacacaactaccaatctttacctggagcccctgggagagggaaagggttttccttattggatgttgaaggccgaattttggccttctggggtttttccaggggtgtcaacccggcattgtacccccggttggtgctcctt

SEQ ID NO: 47461 - DNA, 591 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagacagactccgcggggcgcgcgggggcgggggtgg

SEQ ID NO: 47462 - DNA, 459 bp, Homo sapiens
  misc_feature (4)..(4): n is a, c, g, or t
  misc_feature (26)..(26): n is a, c, g, or t
  misc_feature (28)..(28): n is a, c, g, or t
  misc_feature (30)..(30): n is a, c, g, or t
gcancttgctgcctgcaggttttttngngnaccccccctgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgga

SEQ ID NO: 47463 - DNA, 715 bp, Homo sapiens
tggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttgtatccgtccgtgttgtagactcaaggggaccgcatataggggcaggggaacagagtgtgcaagagggctgaaccacccgtttaattttggggtaaaatgggtagtactttcctttgttattcctaaggtactcttttaatttgatttattaataataacggaattggggttcagggtttagaaacagcagcggcgggaagccggaatcactgatttgggagagtaacaagagtggtagagcaaatctaggaaaggggaatgtgcatattctgtgtggtttcctgaacctacctccccagatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctg

SEQ ID NO: 47464 - DNA, 791 bp, Homo sapiens
cataagctagtacgagcctcggtgaaatcggccgagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgga

SEQ ID NO: 47465 - DNA, 1304 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacaaaaaaaaaagaaaaaaaaaaaaaaagaaaaacaaaaaaaaagagaagagacagagacagaagaagagaaagaagagaaaaaaaaagaagaaaaagagagaaaaagagagaagaaaaaagaagagaagagaaatacaagaagaagaaagaaaataagggggaagagaaaaaagagagagaaagagagaggagaacaagagagaaagaaaggaaggagaaaaggagaaaacacgagagacagaaaacgagagaggtgcgggagtccagagacagagagggagaaggagagaagaagacaagaccggacgacgaaacgcacgaagaaggaggaaaagaagcagagagtgagtgtgcgataacgaccgagaggacgacgcgcgagcaaccagcaga

SEQ ID NO: 47466 - DNA, 1325 bp, Homo sapiens
ccaagggctactgttcccagcgaggcccgcgcggcggcaccgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaagtcaagtgagtatggaggctgagaggcagcatatggcacttcatgctggaaagcttcacaagcagtagctgcagtggtggcattgccccagggagctgtaaatgtttaactagaattactttttccatgagatctttccacctgatttaagggagagatcactgggcagtttgagactgaacccacgtcttaggggaaggaaggtcactcttctgtcctctacccacaagaacatactgtaactctactgcttttcccatccccagagagagggagggagagagaggtggatgaagggtgaaagacaagcagtcttcattcttttaactttccctggtacctgcctatacaggtctagggtggggtctggaggggatcctaacttagtcaagtggatcactgaccttgcagtttcctcattaactgatggcaggaagccagagggctgggcagcttccacccctgcctcccattgtgaaaagaaagtcccttttaaatcctcccctgcctcaccccacaagtctttgctcccccaattcctaaggcatggcatatggattcacggcatt

SEQ ID NO: 47467 - DNA, 496 bp, Homo sapiens
ctatgtgcaaagtgttagaggaatagcacaagaccagtttggcttatcagagtgagcaatggtaataaggtaatggtaggggagggcaaagctgcagggccttttaggtgataggattcagccttttacccttagtgagatacgaaaccaatggatgatgtttgactagaggagtgacatgttctgacttaaattttcaaaagatcactctgttactttgttgagaataaactatagtgaggcaagggctgaagaattttgacaataatctgtatgaaagaaagactagagtagtagcatttgccgtggtgagaagggtttgattttggatatattttaaagataatgctgatagactttgccgctgattgaaatcgggaagtgaattagcctttgatatatgtggaatgacaagacgcccaaagaaggaatcttagtgaatatttacaggtttgagtggaagaagagctagcaaggaggctgaggaggagagagt

SEQ ID NO: 47468 - DNA, 332 bp, Homo sapiens
caaaggacagttcaatactattattacatgcccagtacctaccatagtgcttggttcatgagaggagctgtgtaaatgtctgatgaatgagtgaatgaatgtacgtatgcataaatgctataaaaaaagccagacttaagataacagataccatttgttctacatggcaaattaaagttaaaaggtatgaatgcaggtgcaagaatcacctgtgggtacaaacggaattctgatattatttttgaattctgggtatgatattttatttccgaaatgaaatacctaaatcatttaaaaagcaatatagatatataacagttcctcattcgctc

SEQ ID NO: 47469 - DNA, 2126 bp, Homo sapiens
ggcacgaggacactgcaaggcttagaccagttcgagcggagctccctgtagggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaag

SEQ ID NO: 47470 - DNA, 2686 bp, Homo sapiens
  misc_feature (5)..(5): n is a, c, g, or t
gtccncagcaggcaagtcttctggaggggagaggctcctggcagccgtgaagcccagcgtgtgaggtcccaggtaagagagagggttggccacaaaggactccagcaggtgaggccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaag

SEQ ID NO: 47471 - DNA, 2337 bp, Homo sapiens
  misc_feature (5)..(5): n is a, c, g, or t
gtccncagcaggcaagtcttctggaggggagaggctcctggcagccgtgaagcccagcgtgtgaggtcccaggtaagagagagggttggccacaaaggactccagcaggtgaggccccaggaaacctgccatggcctcctggtgagctgtcctcatccactgctcgctgcctctccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaag

SEQ ID NO: 47472 - DNA, 2283 bp, Homo sapiens
  misc_feature (5)..(5): n is a, c, g, or t
gtccncagcaggcaagtcttctggaggggagaggctcctggcagccgtgaagcccagcgtgtgaggtcccaggtaagagagagggttggccacaaaggactccagcaggtgaggccccaggaaacctgccatggcctcctggtgagctgtcctcatccactgctcgctgcctctccaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaag

SEQ ID NO: 47473 - DNA, 2147 bp, Homo sapiens
  misc_feature (5)..(5): n is a, c, g, or t
gtccncagcaggcaagtcttctggaggggagaggctcctggcagccgtgaagcccagcgtgtgaggtcccaggtaagagagagggttggccacaaaggactccagcaggtgaggccccaggaaacctgccatggcctcctggtgagctgtcctcatccactgctcgctgcctctccagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaag

SEQ ID NO: 47474 - DNA, 274 bp, Homo sapiens
ccgggctactgatgacctcctttggcagggtcaagattggccttaccttgcagtcaacagtcttaggtctctgattcccagtcaagattattcacttagttttatataaaagaactcggtgtttaaagaaaccagcaaaattcctcaaactcattgcttatgtttataggaggaaaggagattgtaaggcacttacattttatacttcaacaagaaaaaccaaaatatatatcaatttcagacaataatcatttaggtattatttccataacaa

SEQ ID NO: 47475 - DNA, 365 bp, Homo sapiens
aagatatctcttccccagaaaaaaataggaccattcattcctctgtatctgtacaaaatgcttcagagtagctacctcattctggagccaaaatggtacctggctcttgggaaaacctggggaggataaatggaaagctcctagagctatagtggcccacctagctccccagagccccgtattttaccccttgaagccaaaaacaaagggagacaattttgtactccatattgtactgatgctgtattttaagataatattctctgcatacttcaccttccagtaacacctactttccttaggttcccactgtgccttcgtatgtgtcctcagtcttacttaccccattgttccaatgacaagct

SEQ ID NO: 47476 - DNA, 594 bp, Homo sapiens
  misc_feature (586)..(587): n is a, c, g, or t
  misc_feature (590)..(594): n is a, c, g, or t
cacatagtttaggtcctggcttaactctacttatgatggttcaacttacactttttcaactttaagatggtgcaaaagcaatacacattcagtatgttcctcgacttaggatgcggttatgtccgataaacccattgtaaattgaaaccaccgaaagtcaaaaaccactttcgacttacgatgtttcccactcacgatgggtttctccggatgtagccccatcataagttgaggagcacctgttagttacttccaactgtctcaggcaacctgggcattcaggagaaaagcctggcacagggtgacagggaagcacccatgcaaagcacccccgctttgactgcttggcagacctagggtgcccgggaagcacaagggatacccttggccctgcggggtgtggcccaggtgcctgccatgagcctgaccccatcgagggggaacctcagcccaccctgggcctgggggtgacaagaacttccacaggttggccccaggcttataggaggcataagcagatcccgcgatggcttgtcattgtcccctgtcctggaacaataaagcaagtgccttgtggtctcactannaannnnn

SEQ ID NO: 47477 - DNA, 544 bp, Homo sapiens
  misc_feature (479)..(479): n is a, c, g, or t
ctactataggctctactatatgcagagccttgggtatttctgtgcgagggggattatgcaaaagaattttaaggcatgccacttgactttgtgaaaccaagtatttgtttaaagagacacgatattatagtgggaggctgttttgtgagaacccacactttcatgtcagcaccctgagatgggatcccattacgccctttaaccaggcaagggactttatgcagttcttcgtcaggaaaatggagacaattaaactgcttttctcataggttgttgtgtaaaaggcagcaagatgtggctgtgtaagaacatgactgaagccagactgcttatgcttaaaacctaggtgagctgtttacacctgatatgaccttggacaagtctcatctaacttctcttgcctcaggtgcctcatctgaagatagcagtgatgttagtgtctgcttcctgcctcataagcctgtcatgttagccagganggtctcaacatggtcgacgcggccgcgaattaatagttgtagtcgaccccggaattcctgaccgg

SEQ ID NO: 47478 - DNA, 282 bp, Homo sapiens
ctgtttacacctgatatgaccttggacaagtctcatctaacttctcttgcctcaggtgcctcatctgaagatagcagtgatgttagtgtctgcttcctgcctcataagcctgtcatgttgagaccatcctggccaacatggtgaaaccccgtctctactaaacatacaaaaattagccaggcatggtgacacgcgcctgtagtcccagctacttgggaggctgaggcaggagaattgtttgaacccgggaggcagaagttgcagtgagcagagatcgctcca

SEQ ID NO: 47479 - DNA, 289 bp, Homo sapiens
gaagaaggaagacacagaggaaggaaagagagggaaagtgagaagaggaggaagcggagaccaccaggaggggaacagggagacagaggaggtgtgggtggccagagcctgcgagaaagaagtgcagagcagagtgggggacagggatggaggcggcgtggagcagctgggggaggagcctgggtcagccggcagggatggaatggacaggagctctgtccaggctggcggaggtgctgctgtccagggtgggagatggaccgtgtggggccccgacaagctgcacaat

SEQ ID NO: 47480 - DNA, 698 bp, Homo sapiens
cttaaacagtagaagaaatagctgttggcataaaggtaccaatgaacttatgtttcctcgtgttaatagagcaaagaaccttcttggtgtttaaacacacatggacacacaggcgtgtgcacacacacacaagcccgaaaatcatgtggttatatttttttagttaagaagagtcacaatgaagccacaaccctgttccatactgctagattcagtatcatgttgtaaggaacatgctggttgaagaaattattttgtttattaattcaggttacatgtcctgccaggctggctggaagagaaaggaaagaaaggtgtaactttaagcacacactgatttgttcttattacataacaaaagtctatttctttatcatgttatcattcagttaataaaaattagctacaataacagcatcaacttaaaaacccctcaaagtccaggggattttctttcacaatgaacatgaatacggttcagaaatacaaacagtcaaaggataactttaggtctgaaagagaaacctggcaagggtaattgaataagcctgggtcccctgactgtgtcatggtgagggcagtcaacatgtcataattaggtttattgagggccattccaacaatctgcttctattcttcctgccttattgtccacagctaggcaaatagccaagggacaaaaggaatcaagtgctgac

SEQ ID NO: 47481 - DNA, 405 bp, Homo sapiens
tggatcagccacttgccagctacttcagctggagcaagttactcaactcacattactatgttctcatctgcaacatggcaataacaatacttttaattgtagagagtaaatatcttgcccagtacagtgtttggcgtacaacaggttctcaagaaaaagggtagctactctgacggcagtgatgatgatgaagcacacttagtaggtgttgtaggccagaatctggggaatgggctgtccaggttcatacgcgggctcccccattcaggagctgagatgccttatgcaagttacttcctgttgctgtgctgaggataaaatggacctactacagagttgttagaatagttaaatgagaatgtgcatgaaaagctcttagtcaagtaccatgttacagttaagtta

SEQ ID NO: 47482 - DNA, 597 bp, Homo sapiens
attgccacagccactccaaccttcagcagccattaccctcatcagccagcagccatccacatcaaggcaagaccttccaccacaaaaaaaattatgactagccataggctcagataacgattagcattttttttagcaataacatatttttaaattaaggtatgtacatttttttaaagacataatgctattacatacttaataaaatacagtatagtgtaaacataacttttatatgcactgggaaacaaaacaaaattatgtgactcagtttattgctatatttgccttgttgaggttgtcagacccacagtatctgtgcggattactggtacagtattcaggggatgcagagctcttagatgtggagggctgactttttgtattaatgggttctgcagggtgtactacaggacttcggcattcgtaggttttcatatcttcaaggggccctggaaccaatccttgcagatactaagggccaactgcattcttgggataaaaggtagattttaaccagccctatatttgtttaaggaaaggataaaaagtctttaaaacaaataatttactatgtctgaagccaatgatcatttt

SEQ ID NO: 47483 - DNA, 325 bp, Homo sapiens
tgagcatggaaatcctacctggactgaggtatcaaaggataccaagagatactagagacaacaaggaacctggaaaaagatagtgttccaacctgtaaataagaaaacagagaaggaggttcattaatatttaagataccagctagtaaattaaaacagcaatgtagttgtctggcttgagtattcagttttatttactacatctttttatcttttctagaagcaaggcattaagtgttgacacttgagtattgaaccaatctgtgatatgacatgaatatgcctttatctttcagaagtttgtctacagacttacaaggaaacc

SEQ ID NO: 47484 - DNA, 234 bp, Homo sapiens
aaacaatagaggattcaattatttaatgtttgtatagcacttagaacagtgccttcctatgataactactattatcatagaataatttgtccaatttagtgttgttgtgaaactttactaactgaattttgttcttcacaagttgatatctttccaacgaatttttcactaaaattttagataaactggaaaacctcattttcaaactgccagataggaggaggcttattttta

SEQ ID NO: 47485 - DNA, 516 bp, Homo sapiens
acctcaccccatcctcaaatcccttccatccagggagtggctcataagacaaccgtctctaaaacaagctcctgggggatagggagactcggagagagaagatcgcagttagggattggctcgggggttctcaatccgatcgttctccagagccattcgaacgccagagcctcccgggcgtcttgagttgggctgggcaggttctgcgaactgcgaccaagtcccactccgctgtcggacacagtctccactcgatgcctgaaacctcctgggaagtgaagttctagggccagcctcactgtaagtcacaggcttctacactacatcttcaggtaatcgaggactacttagatcgcgacctcagtacgagttactcagcccaggaacccccaaacctcatctttcccttggcaaagtgagaccaccccgtgttccccagatccccaagtcctattttctcctttggactaatatgaacttaaagagacacggacatgagaaagtatttgagagaaa

SEQ ID NO: 47486 - DNA, 390 bp, Homo sapiens
atgaatgaggtgttactaggtagtatttatagtaatggacttagctgtcttaacagtacctttagtgttcagaaaattatctgcatttaagatctagtccaactgtcattttagagaaggaagaactgagactcataaattacttggacaactagttagtaactattagggccttggaccctccagagtctcagttccatgctgcttccactctgctacattcattccacaaatatttgttgagtgttaagagccaggcacgatcatcacaacagaaaaacttgctccctcctttcgtgaaatggacagttgagaaggaaagacaaaatacaaaccagtaggaaatcgcagctgataattgagcaaaggagaggcattcagtgaacagag

SEQ ID NO: 47487 - DNA, 403 bp, Homo sapiens
gactgtgctgagctgggctggaggacaggggcagcttttatccctaaagctgggcagaacatgcaccaaggttggcagcctctgctctccttctcctccacccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctcttcttaacaaacagaaagcatgtgctaaataacattttaaaaatatgtgtaatttattcatataactttttttcccctgaaaaaaaa

SEQ ID NO: 47488 - DNA, 348 bp, Homo sapiens
ttattttgggtttctctggctatctaagtgtcctctcatttatcctacacagatgtcttcctctttcgagctctttcttgatacaggtgaaccagtggtggcccatttgtcaatcctattttacaaataaatatcatgcaataatcacagcacttgctaaataaatgtaacaatgaaagagattttgggtctggagggtgtactgccaaggaaatagaaaaagtgagttattatcatcacctttctatgaacctttgattggctggaacttaattttccagaaagggcatcatcagtgtgtaaacttccccaaaatgtatcctaattcatctttccatgtttatgatc

SEQ ID NO: 47489 - DNA, 684 bp, Homo sapiens
accactatactccagcctgggtggcagagtgagactctgtccccaaaaaacaaacaaacaaacaaaaaatcacatcactcccagagattgtaaccacctgagagcttctcattgcacttggcctgatgtccagactcttttctctggcgatccaaaccccccaagatctcgcccttcccttcctccccaccctcgtttcttcccacatcccctcatctgccgtgcagcaaccatgcaggctttctcttgttcttcagatacaccaagcctggttccaccttatggttttgcatttgctgttccctatgtgtgcaatgctcgacctgagcccgggttccctggctcagggaacagaggctgacaccacactcataacacctgatgggatggaggagatggaggtgggcggaagaatgtgtaatcccagacagcagcaagagtaagggagaagggaagcaagagagagaaaacaaaggctgcaaatgcattactgagctgacccatcacttcttgagaaactctagccagttgctctgacacatgggattctttggagtggcaatatggaacacacttataccataatgcaacatatgtgttcccccaaaccaccacactatgcagaattgcactttacaaatcacagggcttatggggaaaatgttgttagggactcaacactgg

SEQ ID NO: 47490 - DNA, 407 bp, Homo sapiens
acaccacactcataacacctgatgggatggaggagatggaggtgggcggaagaatgtgttcctggctcagggaacagaggctgacaccacactcataacacctgatgggatggaggagatggaggtgggcggaagaatgtgtaatcccagacagcagcaagagtaagggagaagggaagcaagagagagaaaacaaaggctgcaaatgcattactgagctgacccatcacttcttgagaaactctagccagttgctctgacacatgggattctttggagtggcaatatggaacacacttataccataatgcaacatatgtgttcccccaaaccaccacactatgcagaattgcactttacaaatcacagggcttatggggaaaatgttgttagggactcaacactgg

SEQ ID NO: 47491 - DNA, 187 bp, Homo sapiens
tttcctcgctgtcaaatgcatgggagagggtgtgtgaagagttaaaatgtatttagatttcactgtagtgtctcctccaacatgatctcacactccttttacagtataagcaggctgatgtcagaggctgtgactcgcccagggctacacagtggacaggtggcagagccaggagccaaggggtggt

SEQ ID NO: 47492 - DNA, 3934 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47493 - DNA, 3797 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47494 - DNA, 3964 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtttaaaaaaaaaattctgtctcattagcaaaa

SEQ ID NO: 47495 - DNA, 3000 bp, Homo sapiens
cttgactgctggtttatatttctggcttgtgtaggaattaaagggtgctaagttaaggttggttctacaggtagctgactcagggaagagagagaatggggtgatattacaagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47496 - DNA, 2670 bp, Homo sapiens
cttcattcagtagcacattgcacagcatcaaaagttaatatgactattaaaaagtagtgcttgtttttgccatgggtttttgtccacacattttgaaaatacacaaagaatagtaatcttcttgctaaaaaatggtttattatcttaggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47497 - DNA, 2639 bp, Homo sapiens
  misc_feature (173)..(174): n is a, c, g, or t
  misc_feature (188)..(188): n is a, c, g, or t
  misc_feature (197)..(198): n is a, c, g, or t
  misc_feature (204)..(205): n is a, c, g, or t
  misc_feature (207)..(207): n is a, c, g, or t
  misc_feature (220)..(220): n is a, c, g, or t
  misc_feature (276)..(276): n is a, c, g, or t
ttgcgaggacacggaaacgaaggccctgaacccacacccaattctctcaaattagaccgcctttccccaccgttaacgtggaaattccccctggcactcccctcccttggaaagaaaagtggcccagaacgccaaacttggcacacccgggtgaaccctggacggaaccagtnntcacacctcggtgnggatccaanngatatnnanaacggcacgttcnccgtggcaacatggaatttcttctgagcggcactccgaccaatggtcagtctgtgnatgagttcatcttgcacttcctccatctgagatttccttcggtccaccggaagttgtttgtgtctctggctgtctcgcacgatactgccaccactgtcactggagctgctgttttgacgtgttatatttgctgggacctttgacacaggaacaggtgctggagtggaagggggaaggggaacaggaacaggagctggtgttggaggaggtgatggagcagggggagtatcagctggtcttgggccatactccatcctttgtttctgtatagtatgagtataaggtggatcagcacgccccatccagattctggaggtctcacatatccaaatgttatttggcacaatccagagtctccacttgcatttcgaactttccaccattgcttccgatcatcaagtatctctaaaatatcatcctttagaaccgagagctcactgttgttccttgctacaaagtcatacttggatttggcatatttcttgggttgtgttttgagtggttcataatttctatctatatggcgattagaagttggcttaaaagcaacagcagcttccccttggtccaggtgggatcctcttgtgtaaatgttgctactgaacgcatagccatcggctggatgatactctgatacactggaatgctctgtggataatctttttatttcctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47498 - DNA, 2033 bp, Homo sapiens
gaaccctgcctgagacgcctccattaccactgcgcagtgagatgaggggactcacagttgccaagaggggtctttgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47499 - DNA, 2478 bp, Homo sapiens
cacctaccttttttaatacaaatggccacaggtccctttctagtattcgtttgtgagttgcaatcataaacatttaaagaccataccattaccctcacaaccatccaccccgtgacatttccattttaacaagggaaatttctaattttaataaattagcattaagatgatggcagaaaaagttatgccttgaacaaaataataccaatattttaaaattatttattggaaacaaaattaaaaatctttgaatatagcgtacatttaaaatgagtaagtgatgctttatgctgttgacatttagacttccagtgcaattggaaattattattagcataaattaaaaaataattataaatctttctgcctcccctcatcttgtgtgattccaagcccaaattctgttttcttgacatttattactataatactactatttgctattgacgtagccttgtgactccttaactaatgttttgactttgaacaaattatgtagaatgtttaaaatatgatttttaatggtcattataccatataggattacagataaatgagtaatgggtttgcaagtaagtttaaaaatagccaacaatgtcctatcaaagtataatttgttttcctagcctaggtttatattttttaaattttaagttaattatttgtctttttatagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47500 - DNA, 1451 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaagatttgaatgaactgtaaagtacagccataccttggacatgcaaatataaatctatggagcattctcaagacagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgtt

SEQ ID NO: 47501 - DNA, 2973 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaaacccatgcaaacctgagtgagcacaggatttgcttctaggtcctgtgactctgggcactgtttgactctg

SEQ ID NO: 47502 - DNA, 2564 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaggatggagtatgggccaagaaccagtggatatgcccctggttccataactccttcaaaccagtccgggtctggaccccgttcgcatgtccatgcagcacagggcacggggcaaaaggtcccggcactatagaaggtccaaaacggcgatccggggacaacacggtggggacgaacttctggagcgacagcacaggacacagacaagtgcgtggaccacgcggaacccaactgagggacgacagagaaaccaccagacgcgaagagttaggccgcacaaccacgcggcggggagagggccacaacatcagaccaccggcgacgtgtcagtagcgtacaacgatagcactgatgagagcaatcagaggagcagaggacaacactgggcagcctcattaaggctacacatcactatctaaagaacaagt

SEQ ID NO: 47503 - DNA, 1454 bp, Homo sapiens
gcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactgtgagtcttcctagaattaatacttattgaacacttactttgggttgggacatagttcttgctttcaaattctgatgctgatttcagaactgaagcttgaggttagtttttaaaaaatcaactctggccgggcgcagtggctcatgcctgtaatcccagtgctttgggaggccgaggcgggcggatcacctgaggtcaggagtttgagaccagcatgaccaatatgatgaaaccccgtctctattaaaaatacaaaaattaggtgggtgtggtggcatgcgcctataatcctagctactgggatggttgagacaggagaatcacttgaaccgggaggcggaggttgcagtaagctgagatcacgccattgcaccccagcctggacaacaagaccaaaactccatttc

SEQ ID NO: 47504 - DNA, 453 bp, Homo sapiens
ttcagtacttagtcccctattgaataaggacacaattgatttcttaaattatactgtcaatggtgatgaacggcagctgtggatgtcattgggaggaacttggatgaaagccaggtaagcatttaccacctataatgccttaagtaccattctttgttaattacatggatctaatgagacatttatttaaccttctacatacgaaggactaagcgtcataggatgaaaaaacctaaacccttaaaggctagaagtctagtggaagagatagaagtgtatgtaatataaggcatgatataccttaggagtgagtcataaacaaaatgctgttggttggcaagggggaccagtcaggaagaggatttagacaggagggtagttagctttcaaagaagagctgtcatttaaaatcgacaggtacacatagggttcacacacacatacacatgcgcg

SEQ ID NO: 47505 - DNA, 413 bp, Homo sapiens
tacagataaatgagtaatgggtttgcaagtaagtttaaaaatagccaacaatgtcctatcaaagtataatttgttttcctagcctaggtttatattttttaaattttaagttaattatttgtctttttatagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgtaagtttcccagggaggcaaaaaatgtcttctgcaaattaaaagcactactaagtaa

SEQ ID NO: 47506 - DNA, 926 bp, Homo sapiens
ggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggtaagagccccttggcgaaaggcgccggtcccggggtccggcggctttgactttctcgattttaaaaatccgcctttgtgtgctggaatcggagcggtgccaggagccgcgtccgcctcccttcactttgactgctttcaactggtgttggcagccaggtgcggtagggcgctgcggccggaggcgtccgctcgccgggtccgggcaagctgtggggcccgtgcagacccgcgcccagggctccgggaggctgggcagggagggttcgccgtggcccagtgatattcatggtaacctgagcttccgcagatacacctgcgctcatctggtccgtggggcgactgcagaccgagtatcccgatctcggcttattacgttagacttgggatttgtgcgctgctctgccaacccgcctcaaatggggaggggttcttttcaaaatgaccctttagggcagggtcccacccccgtttaccccctcgaattaacatagctaattgtttcggaatcgttgtcaatgcctaatggctgttgactttcttagcttgctccactttactcaccattttacttttgggaagacagacggcctttctccggttgtggtcagttcatgcatttgaaaggggtttccccacccatgtactccctgccctctccgatgttctcactcttactttccttcctag

SEQ ID NO: 47507 - DNA, 476 bp, Homo sapiens
gggaggatggcttgaggccgggagttcaagactagcctgggcaacattgggaaaccctgtctctacaaaaaataaaaaaagggttgggtgtggtgatgccctcctgtggtcccgatacttaggaggctgaggtgggaggattacttgagctgcagcctgggtgatatagcaagactctgtctaaaaaaaaaaaaaaaaaaagatgttgatgattgattggttgaaagtttgttaaactaacaggaagatacagtattctagaaacacaatactaaccaatttccttgggttctgttattgtcagataaacttcttaattgtgccaacgttgtgacttcaaaaactgtacatttcacattgaaaagaaaaaatcaacagagaacatttcatccctaggtgtttcatgtcctgtgctaagcgggccggtgagaagcccaaggtaatatgcatcaataaacccactttgtttctaaagc

SEQ ID NO: 47508 - DNA, 309 bp, Homo sapiens
gcttccttgcacagagctcctagcaagagaatgctctctggagctgtcaggcttctctgtgccctttccacagacgctggatcactgagttatggctcatttgcttcctgtatccccattcaccatagctaggagtgactatccatctccttcttatagcagtgcggggagttgtggctgcagtgttaaatgcctcatctccctgccaatgccttggttttcatggtctgttctgcacagtgtcgagccttggaagtgtcattttgaagggcccagtgtttgaatgcaataaagtggatataatacctc

SEQ ID NO: 47509 - DNA, 437 bp, Homo sapiens
aatctctgtaactgagctttatcatcctgctttttagaaactgagaaaaccaagactcaaagtgttgggattctcatgccaccactttgtaggtgtgtgccagcagctcaattactttgcctttattcacttttcttatctataaaaagagagtaataccccctaacacctaaaattgttttgaggaaaaaaatgagttaatagagacaaacactcttaagatagtgtctcacacatcctaaactctcaatagatattaactattattatttgtcatataacacttcgtgatgatctgattaatatctgctcaccccctcactaagataccagctccatgaagaaagaggccttctcaggttttgcttactatcaccaagcacacgcctataacataataagatcttggaatgaataaaataatgagatcaagatga

SEQ ID NO: 47510 - DNA, 479 bp, Homo sapiens
atagagacagggtctcactatgtttcccaggctggtttcgaactcctgagctcatgcaatcctcttgcctcagcctcccaaagtactgggattacaggcatgagccaccacgcccaaccataatttaaaattttctagcaaattattattttttaaagctctcttatatgacagaaacctttcaaagaaaaattctgtagctactgttgtgattactggggacagagtagggaaaaaggatggtcaataactcctcaatggataaaaaacaaaatccagtactcctttttcagacagggtttcactccatcacctagactggagtgcagtggttccatcattgccactgtaaccttaaattcctgggcttaagcaatcctactgcctcagcctcccaagtagctaggactaccagtacgtgccaccacacccacctaatttttaaatttttgtagagatggttactgctatgttgacca

SEQ ID NO: 47511 - DNA, 749 bp, Homo sapiens
cttgtccagaggcttcttcctaagaactcagtgccaggattttgagtagcactggatattctgtgcaatgggttcgttcatccaatttccaccactttacagatgaactggggatcagagaaggcaagccacctccccaaggtcacacagcttgtgagagcaagacaacagcatcgaggcctatgtaatagcagagccattgcttctttggctctgcggaagcttgtattgtggtatatctgtggtgtagctttgctgtctcctgtgtcaatgtcaggaggacaggctgagctcctgggaccagaacccctcagattccaggaggagcagagaaagcacagatggcctggagagtcccaggggtgaggccagcaagtactttcttcccccaggtgctcagagcatcctctgagttgccaaacagactcccagaggggtcaactgtgggccctaaaccagacagcagctgggaagcaggctctcaggggaactggggtctcaccagctcaggagcaggccaggactcctcagcacagaagctgggaatcttgagtgtccagatcagcctgaaaatctggacttgggaaaagccatctggctggggccacctgcatgccgctgtgactggggcatcctgctgctctcctctctcacaaggtgggtgccatctgccttgtcactgctcctcaggacaagcctgactgctctccctgcacctctggccattgagaatccggctgctccatcgt

SEQ ID NO: 47512 - DNA, 402 bp, Homo sapiens
tagaacaggaagaatggagcaaggaaccagagctcacagctctggaatggaaactgactcatgtggaaaaacagccacccctcagcagattttttttggcttcttttatatagaaagtatatacttaaatatggcaaatagcttgctacttctctaagcaccagtttcctcatctgtagaggggttagtatcttctttataaacttgttaagagacttacacaaaaataacttgttaaatgcctggcatagtacctcttccctatttagttgccccctccgttatatactcagcaagttcagaatgaaagtttagaatgtgaagagttaaagaaaaagcaaaatgtaaatgccctggcagagcttcacaagaaaatttgctacagagtggaattcagctaaa

SEQ ID NO: 47513 - DNA, 304 bp, Homo sapiens
atccacttgtatgttcattttgggctctaggtgtgatgaattaaagtattaatgttttctaactataatttactagcagtggaagtgatgagaaatggtcaaatttggggtatatttagatgacagtggccaacgatgttctctcactgcgggtcacttcattaaggactggtgtggacagtgtcagcaacctttgctcaagttgccatcttttccaagattattttatctaatctcacttcttagttatttcttccttccaaatctactttataactgcttcaaatcatatcattctaaacac

SEQ ID NO: 47514 - DNA, 475 bp, Homo sapiens
atatcctgtataaaaattaagaggttgtaaagatattgaaacattccactaaaatacatgtcagatgccagctgaattttgggtgagataagatgcaaagtggatctgtagtaagagaaagaagttaagtatcaaatacctatctggaattttatgcagtgaatatgagaacactgtgaaaatctattgggaagtaataaatttgttacacatagaaacagttgagtattttacaagtggaacatatggctataatattactttgggaaaacatactgccaatatcaacctaagaaaaagaaaaactgatattcttctctctccaaaatgggctttgataaattatgtataaaatgttcaatttgttttaagaaatctatcttaacaaatctatcagtgtttttgttgtttttcaacacttttgcagtacttttagcatggtacatacattaaaaatattagccattaggcactt

SEQ ID NO: 47515 - DNA, 272 bp, Homo sapiens
tttggacttgatcccataggtaaaaagaacttttaatgagaaagtgatcatttgatccactggggtctgtcaggtgtcttaggtcagattccccagaagcagagcctgaggcagggattcttgtcacagaggtttgttgggagagtgcctcagaacagaagggatgtgggaagcttggtggtgggacaccaagtaagggtgtggtcccttggacatgagcttccttctgtccagagggaagctccatggcacatattgcaggacagatttgt

SEQ ID NO: 47516 - DNA, 432 bp, Homo sapiens
gcttcagtgtaactggagcaataccagctgattctaacagtgtggcccagcagcgcctgctggctgggagcagggacagaaaatgcctgaggctccgaggtgggagcccaggctgggattcaggatttcgctgctccccgttcaaggcctctggagaatgttccaaagggaggtgtggatgtttcattcagtactttggagggagaaagaaatgggttctttctctgtattctctaagatagatttgttcttaatcttgaaaaatcatttctagccattttagaaaaaaaaaaacattagtacagtattagtaaatatggatgggataaaattttttttacatacacataggattcaatacatttttcatatgctgaccttataagtcatattgttttgaaattatatttattaaaaatgtgattagagtta

SEQ ID NO: 47517 - DNA, 384 bp, Homo sapiens
accacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagc

SEQ ID NO: 47518 - DNA, 325 bp, Homo sapiens
tctcttgatagcttaaagaatctgcttttgtggtgattcctagggaagtactgacagattttactccctctcttctactgttcacttgctacaacttgcatactggattgaaggttagaattggggttaaaaagtgaaaaagtcagggaaaagtatagtatttcaggctgagccttcctggttaccatgctgccttgccctcatgggacatgcttctgtgaatgtagcgcaatgcaagggtaaagtgcaccgtgattgtgcaggtgaatcacatcagtctgatgacagaggctgtcaaagagcatagatggcatatgactcttct

SEQ ID NO: 47519 - DNA, 459 bp, Homo sapiens
atactactcctctgcttagacaccccagtgcctttccactgaagtcagaataatatccaaatttcttattatggccatccagttcgtctgttaccaaaccccagttgttctctcaacccaaattcttttattctttctctgatttattctgctataattccactgttttttttcttctttttttatcatgcatataaagttgtgtctgcttgaaggactttttagttgctgttctgttaccaggaacagtttttcctctgacattcacattcttggcttctacctaagatttaagattcaattcagatatctcctacttactcagaggggtctttttaaaccttcctgtctaaaatagtacatagcacttcctaatagtatatattttttagtttgggagacctgtatggacaagaaatcattttttttttttaagacagagcctcactctgttgccca

SEQ ID NO: 47520 - DNA, 1690 bp, Homo sapiens
ccacgcgtccgggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggtaatgaaagtcgtgtagccgccgtctcagcctccctgagccgctccgccaggtcccttacggcccgggaccgctgagggggccgacccaactgctgccgcactctcttgaacgcggatagctgaagtcggggtgcacgacttttttggggagcggggacgtgaagtacagcgctagagaggccgcccagagggctgtggagctccggaaggagccttaggagtttgttgtcgtggtagacagactcccccgggagctttctctgactccgaaccctgccttgctctgacttcctgttggagatgatcgattcgagagagggaaagagccgagaacgccctgaatctcaaatcacctcgtttcacccaccggcagcgtcaagcggggttttgtccagtcgtcgagttacgtatatgggaccgattctcatctcttccggggcttaatgttctgtggctggtttctcttttgtctgccctccccggcaaatctctttggtgcctcatgatatatttcactgctgaattttctcaattaccaagtggactgtttaatgtacagctttactccccctcctcttccagttatccgaaagaaataatgaatatcgcatcagtcttggaatgtgtattaagactgtaaggtgaaaataagcggcataaaccaggcagtattttacttgctggttaaatgaatgacccccttattttattttggatatagccagaaccgaaaaactttgaaaaccttccttagtctctacacaaaacacactcggtcaacacatttcataatagttcctctttcaacatagttctccatttgtgcttacttaaactactttgatggacttatcaattatttctcccaaacaaaatgagagattttccaattgggtattatgaccagttaactctttgcttaaggcaacaatatctttacccaagattacttttataataaatgtattaacgttttggaatcacagacctttctgcatgatttccaatccccagcagaatgtattcaggtaagctctggtctctaagagtcagagttaggaaattgaaagctttttgcagcttttctcagccccgtctttctgcccctacttctcatacacacccttcttgggtcacatggtacctttattctctgttagtcatactcgatagtagcattttataatgtaggggaagaaagtactatgctttctatttcacaagaagattgcacctgccatttaaagttatctgatgggcggtttttaaaagatattgttttcctcagcctttggctttctaacaatgttcttttagcttgaattgtctgccttagagaaagttgcatatttcatttttattttagttttttcttttgaactcaggctaaatctaaactaaataaaatgccttt

SEQ ID NO: 47521 - DNA, 3813 bp, Homo sapiens
ccacgcgtccgggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgagatggttggtaaaggctttttcctagttcagacaaaggaagtgtccatgaaagctgaggatgctcaaagggtttttcgggaaaaagcacctgacttccttcctcttctgaacaaaggtcctgttattgccttggagtttaatggggatggtgctgtagaagtatgtcaacttattgtaaacgagatattcaatgggaccaagatgtttgtatctgaaagcaaggagacggcatctggagatgtagacagcttctacaactttgctgatatacagatgggaatatgaagtgcaatgtggaaccaggacttggtattaagcctttcccaacttgtgaatatagaatttgataatacacttttgtgtattagcaatggtttttactaatgctaaaacttttaaagtttattttttaataaattgttgagtattacatcatttacttgaggttcaaaaataattcattttaaattaagtagttttaatcagcttaaaagctatttaacccattttaataagcttgcagttttgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaattaagagggatttgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattagaccaaacccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcctgagtagctgggaatacagcatgcgccactacacctggctaatttttgtatttttagttgagatggggtttttccacgttggtcaggctggtctcgaactcctgacctcaggtgatccgtccacctcagcctcccaaagagctgggattacaggtgtgagctaccgcgcctggccatgatgatattattaaacaccattattcacatttcaaataataacaatactttttgtttttcaaaaataaaatgcaatgttatataaagctataaactaagttctttatgatatttgagcaacaactcaggaatataacatataagggagatgttaatttaaaaatttccactacacttattatctattaaccaaagcttaaaattttgtattcttctgttagataagaccttttacccatttaatttgtctttaaggacagtcatttggcttctgaatgtttgaaacgattttaaaaaataagtagtgctatggttgtttctataattctaacctttgatagtaatcagaatgtattacatttcatttctgaatagcttttgaatttatgaaaaattattaacaatgaaaaattggtaattttattaagttatatgtgtttaaatattatattagcttatttctcttgcattaatagtactgctgtttttgttttgcttctttatatttatgtctagcttttatatgtaatttatctagtgtttataaaatgtgatttgtaataaatgttgttaaaatgaaaa

SEQ ID NO: 47522 - DNA, 373 bp, Homo sapiens
caataaaatgagagccttaaaaagtattgaaattatggaatgcttatcagaaaggcaggggaaagactttcccactgttttcaatcatcttctttaaaaaatgattttaattttgtgcaactactgttctctatgcatgtcaagtgtcagaaaccacatatttcaacaaagttcctgaatattgtggataactaacatatgtaaaataatgctctatatctattggggcagagtatttaaggagatgaaatggcattagctcccatgccacaaaagcaaactagaatactgtggggaaatatgtcagtatgaacattaattgatacataagccagatttacgagagtataaatcagccctgggtgcggtggct

SEQ ID NO: 47523 - DNA, 433 bp, Homo sapiens
tgaaaattggcacatcctaccagactaatatgtgtacacagtacactattacctcacctttaatattcattgtgtccacagctgggataaatacttgcgttgggtgaccatggggcagagcagcctgtgctttgtgtatatgaagagttttctagaaggtgaactcatcccaataaaaaactgagtcaaacaggcaagttcagccttatcttatctaagaataaagcctcagatagaggagatgggcaattctgagtgtagcacaatggagcaaagcgattgttcaaaacgtttatctttggcaatctcaggaaaatgccatggaaaataacctggagcagaagaggggaaggaagcatgagcatgtgattgtaaatgagacacatcccagtggccttacataaatatacacctgggtagaactgtagacatg

SEQ ID NO: 47524 - DNA, 584 bp, Homo sapiens
attaattcctctaaacagaggaccacttccacgctaaatcatacctgaagagtgggctccaggtaattgcaggtatgaacaaattaggcattctcttttacatacagcccggcggccagcatcctggcgttgggcaaatccattcatcatcctgacgttctccagttgatccgtcttctcagagccattagcccccacgtccttgacggtggaacagttgtaaactcgagaccatccgtggggtggctgagactgacaattcattacgcagttggatggagaaggcggctcaggtgacaatgctgaggcctcccagttcccagaagctggctccgcttggaattggcaactgctggctaattttagaacagtcatcgttggggatggagaaggaggaggaggcagctttgactttggggtcagacgagcgggtcctgcagaaattggctgagctcagtaacacattgatcaccaaggcaagtggtcatcttcgttcaggtgggcatgggacagtggtccctgagccagcccaggatacattcaagtgcccccaaaaggacattccaggggagccaatgaaggga

SEQ ID NO: 47525 - DNA, 254 bp, Homo sapiens
taaagtttccaagaaaattccttttgttcagtgatatgtgaagcaaagggggaactggcttcttgaagttacattgtgaaaaaccctcacagggtttggggttcatataaaatgtagattgggacatcccttatgacttgcgatagtgctgtaagaaatagcttttctatagttggactgggatatgttacttctaattggatggttatggtgaccctggtattaactttggctaaattatctaatgatgatgg

SEQ ID NO: 47526 - DNA, 347 bp, Homo sapiens
cagaaattcagactttttaaatgcaaaatcttctgatttttaagtatttgagactaatcaaatgaaaatggtttaaaaataaaaccgcaatcctactgcccacatttgccccatatgatgcagatacgaatgtatctattattgctccatgaggcagctcttgtcattttaaggaaacttgatgaattatttaaaggaacatcttgatactattttttaagataaatatttaaaggctgggcgcagtgggtcacacctgtaatttcagcattttgggaggccgaggtgggtggatatcttgagctcaggagttcgagactagtctgggcaacatacagaaaccctgt

SEQ ID NO: 47527 - DNA, 733 bp, Homo sapiens
  misc_feature (725)..(733): n is a, c, g, or t
taaccaagacaaagtggtctctgtgtgctaagcactgtgcttatgcactgaatcatcatttcatcctcagaactaccctttatcaggtgggtgtcattatccccatcatatagctccacagaatccttaagtgacttgcccaaaatcacacagctactaaatgatggtgctggattcaaaaccaggctggtcaaatatctgggtccatttttgtaaccactatgttaaaaaaaagattcatcaaaggatcaaaactaatactagatggctttcatgtttcatggaggaaataaagactcagagatgacagaccaattcttcagcggcccctgcacctcatggatacttttcaggtgatggaggagtagaactacactgaaaatttgcatttgaataaggaacaaggaaaaaaaaaacttggaaatcaagtaacctaaagcaaattcacaaaaatagaaataactggctcaagaataacaagtataaatgtagggtgctcataatgagacttcataacgtgatagaagggtgccttttcttctgatttctacatggagcaggaggacctcagggaggtctgaacggcggcatgagagctcgtgcagatgaccagaggacccacgtcctccaggctgctgacttaaaatgggaagctgtttgggcagctcatttctgttttccaaactttgcaatttgagaaaaaaaaaatccaactgttaaatcannnnnnnnn

SEQ ID NO: 47528 - DNA, 966 bp, Homo sapiens
agcaaacctcccacagttgggattacaggcacatgccaccacgcccagctaaaattaaaaaaatttgtagaaacgggtgtcttgctgttttgcccaggctgatctcaaactcctggcctcaagtgatcctcccaccttggcctcccaaagggcatgaaccatcgcatccagcttgtctccaagttttttgatcttgtatcttacacttaaaaatcttgagtacacactcctaatatggaaatatgtataaataatatgactgtgttactgcactatgatgatgttttaaagtatgccacaattttgagggataagagaaaaatgaacggagatcatatttcttcccacattccagtaggcattttgcactccctactgtgtacacaatccactttgtaagcctctggcttttgagatagagtctacttacaagccaactagctgtcgccctcccttcgttcctgggttaagtttgctttccagtgaaacactctgcaaccattgaagaatgcaggctacctgccaggtatttggcttctaaagaagtcccaagaagtactaagtggaagaagcaagtattaatatatatgtatggtctgatttcttgtgtgaaaattttttacatttgtaaaaatgtataatttattcagagaaaatctctagattgatacattaaaagctgttaagttatttctgagcactgggattaagggccttgggagagtaagaagatttttattttttacttcactcttctgcactgcttgaatttttaatgaaccggattcttttcgtaataaataatttttaaaatcactaaatatattaggatgtcaactatgttacaatgcattgccaatgttgattgttgaagttgggtgatgggcatgttgggtttcattgtattcttctctacttttatgtgtatttgaatatttccataataaaaacttttaaataaaaaat

SEQ ID NO: 47529 - DNA, 203 bp, Homo sapiens
gtattattacagatatttataattattaaatttattatgcaaaataatattggaaatttatcttttaaaatgggtgaggctgatggtttccctttttattcatttagttcatctattcattaatctgtattacctgaatgaaactttcagaacaattttactctttcttaaaaattgacacataacaattgtacatatttatg

SEQ ID NO: 47530 - DNA, 535 bp, Homo sapiens
gaattctgtgagtgtttatattcaaacaagagtcccatatatttccttgccatgggctaaatcatctttaagactttctttgctattactgtatctgctgtaacagcggcagagatgttcttcccaaagacacaggcttaagcaggcctttttcacatgaagctgttctgaaagacagcaccagtattagttactgcatcaactacccaaaagaagcatccaagttcaaaactacaaaatcagtgtgaaaccacttcaaaagctcctacttatcaggccagacatggtggctcatgcctgtaaacccagcacttttgggaggccaaggagggaggattgcatgaggcaaggagtttgagcccagcctgggcaatacagcaagaccctatctctaaattttaaaattagccaggcatggtggtacatgccggtagtactagctacttaggaggctgaagcaggaggattccctgaacccaggagttcaaggttatagtgagcaccaatgcactccagcctgagtgtctgagcaaga

SEQ ID NO: 47531 - DNA, 1420 bp, Homo sapiens
aagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctcttaaaaacaattagtctgacaaatcaaatcaaatcatttatgtttatttacgtagaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgcccaaaaaaaaaaagaaaagaagatgaaaaagcatcacatgaagtagtgacagagagcatgcaggcaagacaacaaaaaagagagtgggggcgcaaaaaaacccaggagaggggaccgaaaagagaggcgcgaagtttagagaaagaggcccacagagagcgaataacagaagagggggcagagataacgatgagagaaaacgagagaggatatgaggaggacttac

SEQ ID NO: 47532 - DNA, 1197 bp, Homo sapiens
aagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctcttaaaaacaattagtctgacaaatcaaatcaaatcatttatgtttatttacgtagaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgccca

SEQ ID NO: 47533 - DNA, 1141 bp, Homo sapiens
aagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgccca

SEQ ID NO: 47534 - DNA, 540 bp, Homo sapiens
tgtaatgagagtcactatatttcttagctccattccaaaatattaactggggagctgctcatttataatagtgccaaacttctgacagacagaaattataaaagaggccccagaaaagcatcagaaaaaaagggaaacttttaaacagaaatggtaatttgaaatactgaccctaggtttaaaatttagaaaaggcctgttttctggagcagtcatctggatggtccaacagctccctctactcctccaagagggaaacatgaaacacagcagggctgtgtggaagtgtgagcagcccaggcttggggaaagccacatgtttccttgttccagccaggagctccaaaatggcctccagccatcggtcctattaaataacataactcacctaaagcagagaatccatggacccagtagaagtaaattgctgacccagttaaaatctatggagaatgtgtcctacggcatatccacgaatataccttcaaaaggaaagaggttatgtccaagcgaagatgaggaatatctgaggtgaaactt

SEQ ID NO: 47535 - DNA, 3033 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacaggtgcaaaactggttatcttccttttccacaagctcagtgtttgaatagctttctgcatgattataatgtaactttaccttccaagtacaagaagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatctta

SEQ ID NO: 47536 - DNA, 701 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggaggatattttgtaaaacttgattttggatatcagtgacatactgcattgatcactgcaagataatataagctgtttctt

SEQ ID NO: 47537 - DNA, 340 bp, Homo sapiens
aaaaaacagaaaattgttttctattagaaataggaattttcatatttttcttctgctttcattttttaaaagtaattattgtctatggaaacccatgttttcaaaattccctttagggagaatttggcatgagagagagctccaattcgagttacatttaaagggttttattgcttgaaatgttcataggatggagtcttgggattccatcccaaggtggtttactgtacaaagctcctatacttgggatccaggtacaatatctgatgagacgatttgtttgagggagggaaagcgccttagttgtgtaagagattaaatctagtaacttttgttttag

SEQ ID NO: 47538 - DNA, 709 bp, Homo sapiens
gtggggtggggtgatcctctgaaactgcagacctgtctgtgtctcttgattgatgttgctcttttatttgttgcagattttgcaggactgtccagaagagcctgaagctattaatgatgaggagcaatttgatgaaattgaagcagttgggaaatcacttttggatagattaactgttccagtagtttatcctgatgggtatggggcatgttcttataattttattttttattggtgtggtcttaaagtgaaatcattaaaagaggaaatctattctttaaaaagccaagtaaattaggtttggtccacatctttaactcctacgatgaattagtttaaaatgaaaagaaatccacacctcttagccacagtaatggtacttgccaacaacagatgcgttacttcttgacagcttgttgtagaatgatcattgactagattaagacactgggttctagccttggctatgatggtggggaatagtgtgacttggggcttcattcaggaaaaggaagaggggacaagggattgatgtttagtgagttcacaatatatgccaagtaccaagtgaaacatttcaccttcattacttttgaccaaagaggaccaaaccagtatgattattcctgatttacaaatgaagaaactgaggcccacagagattaagtaaggctctcaggatttcacagcttctaagagttagcataaa

SEQ ID NO: 47539 - DNA, 187 bp, Homo sapiens
tctagagtatccccgtacccaggctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagtgcgcctgggtg

SEQ ID NO: 47540 - DNA, 2939 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatctta

SEQ ID NO: 47541 - DNA, 3000 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattctt

SEQ ID NO: 47542 - DNA, 1494 bp, Homo sapiens
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgtgagaggctttttcctctgcaagttacaatgatattatgaacgtgggtaattagtagcatatgtggtactgagtgataagttgctgcaaactttggtatggggcatgaagtacagtttgttaagtgcctagaggtcataaagtacattttgattacttagtacatgttaattagaaggttgtttttggttttgtctctaatgcagtttaattatatttttatagaagcacaatttgcatgaaattttaaaagctacagtgacagaaaaa

SEQ ID NO: 47543 - DNA, 892 bp, Homo sapiens
gaaccattagagcccagtagaatacttcagtagaataatgctttaaaaatgtttctctagtcatgccattccctgtttcaaatactttagcacattcctattctacttaggataaatcctccacaggacctgtagacttctgagtcacatggcccaggcctcccttccaaacaccatttgatgaccctctaccttgctcaagaaaacactgggcctactgaccttctcttaatactggtaactccttatcactgagtcaggaccttcttttcttaagcccaggagactttttcttccactcattctcctgtgtaaatgtcctctccttagagacatcatcctatgttgattcagattccaagttctctccagtctaattctccttcagccgaattctttcttacagtgtcctattcttggctttcatttgatttctcacaattaataattttgcatatatttgcatgtttgtctgtctctgctactgggctgtaagagacatgtcagttttgctcactggtctatacctagtctcaacatagtacttggcatatagtaagcactcattaaactgtgaagtgtgtgtgtgtgtgtgtgtgtgtgtgtgtgtgtgtgtgtgtgtatgtatacatatatatgtgtacatacacattttagtgtatgtatattctcatgtattctacaagattttgggcaagtgtatcctatattacatataaagacagtaagagaataacttacagagttaaaagtaagtgtaaaaggagcagttatattaaattttgaaaagaataaactattaattatgtaattctccattgttccatgaaaacagatgtgactattcattagcactgactaatgaaggatatgttatttcagataatctatc

SEQ ID NO: 47544 - DNA, 367 bp, Homo sapiens
gttctgcaacattgttcatgttcaatgggagaacacaggcctaactagtagacacaggccagctcccagatgccaggggctgcttttctttttctcacttgtcagctgcgaagcgggaatggtctgcatccgcacgttgtcaagcaggaaatggcacatcagttatgaacttgacgggatctgccaccataggcctaacgctggtgctgcaggttgtccctgatttggcctcttttgtctgatctcaattggtcaaaactcaaaggggagaaagcctgcaatgggcagctccagcaccccatgtataaaggaaaccttgtaagtaaacacaaggaccagcattagaggtaccaaacaccatgctagg

SEQ ID NO: 47545 - DNA, 415 bp, Homo sapiens
gttggaccaagcaactgggcaccacagcacagccaagttaacacataaaattaaccgtcacattcccttagctgctcaatgtttatgtctcatggggtagttgaaaaacatatggatacagctttgacacttggttcatatactcacttgctgggttgccttgggcaagtttcttaatctccccaaatagcaattcccttgtttacaaaataaggactataattattagtctatgtgtttgtctttatgattttctttttatgtcagcgccatgcctatcatagtgccagttacacaaatacttgatgaacaaatgaagtacttaatgatgaaagcaggaaagagacttgagtttttatgtcaccccaaggaagagctagatttggacttcagaatcaggataaaagttttctag

SEQ ID NO: 47546 - DNA, 214 bp, Homo sapiens
tgtaaacaggatgaggggtaaagaagtaaaaactctcttcaaagatttgactagaaataatagagaagaaagtggtaacagagcaaatcttcaaaaaaggattttctttcttttctattgtatgcttatttttatgtatatttgatgggagataatcatgcatgtttatatgctaagaagaaagaacttataaagaataaaaagttgagcatat

SEQ ID NO: 47547 - DNA, 286 bp, Homo sapiens
atgtaccaccacacctggctaatttttttaattttttatattgtaggcataggatactgtgttacccgggatggtctggcctcaggcaatcttcccaccttggcctcccaggtgacgttgccttatacacagaaaatcttaaagaccccataaaaaacttttgaactaacaaaagaattcagtaacgatacagaatacaaaatcaacatttaaaaactagcatttctacacacagtgaactatctgaaaaaccagtaaaaacagccccatttacacttgctacaga

SEQ ID NO: 47548 - DNA, 285 bp, Homo sapiens
actggttcctatttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcgtcacagtaggacaccaaaccctctgtatgccctgcctgcctc

SEQ ID NO: 47549 - DNA, 1282 bp, Homo sapiens
gcacgagctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtcctgatttagcactatttacatacagggcatactttacaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatactt

SEQ ID NO: 47550 - DNA, 535 bp, Homo sapiens
  misc_feature (382)..(383): n is a, c, g, or t
gaaccaacagtcgtcaacatccttctccttacaatgggacacaggatcaggttggaccggctggggtaatttgtcccgactttctaccttggtaatgttaaaataggaacattcctgtgtgcatgtgtctttcttttctcctttattgaaggctctgcactgaacacattctttatgctcagcacagacaccaaggcaggtctgacacatctcacacgtttgcccttgaaacttcggatctgtacacttacagacaccacactcgcagatgccccggccattgcagatctgtccgttgctggcttcacaagtactagtatccaaagaacagtcacatgcactgccagtgtagttggggttgcactcacacacacgacacttnnaaacaccatttcctccacaaattaagccattggatctaagctgttgtaactggagctgttgtaactggggctgttgccaagtcagacggtggtaaacctaatgagtaaaaagatcgcgcgcgttgcttgaataatatccactctgatatacg

SEQ ID NO: 47551 - DNA, 1362 bp, Homo sapiens
gaaccaacagtcgtcaacatccttctccttacaatgggacacaggatcaggttggaccggctggggtaatttgtcccgactttctaccttggtaatgttaaaataggaacattcctgtgtgcatgtgtctttcttttctcctttattgaaggctctgcactgaacacattctttatgctcagcacagacaccaaggcaggtctgacacatctcacacgtttgcccttgaaacttcggatctgtacacttacagacaccacactcgcagatgccccggccattgcagatctgtccgttgctggcttcacaagtactagtattataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtcctgatttagcactatttacatacagggcatactttacaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatactt

SEQ ID NO: 47552 - DNA, 909 bp, Homo sapiens
aaaggaagcaggaaaaaaggaaatctttatgggaaatcaattacccaaagcaaggtgagtcacctagaggtgaatatgatgttgttattgtcctcccttagtgtacagcacagtttttgctctcacagggtttttctctttaggatgcgtagcaccctatgcattaaatacatagcatcctaaagacaccctactcaccatgagtctgtaggctctttcctgatgagggcactggccatatatgaatggaaaactcaactcatctcctcagctttagatgttgctgctgttcagctggatttgtgagaaatatctggattactatcaagaacatttagcaagactcaaaagagagaggcaagcagaaccaaaacccaaacctcaaccaatgactagctgaataaacaattctttggaggaataaggaaggtatttctggatgtattctgagaatgctcttccaaaagggaagatggtaataatggacttgttttgaatttccatggttgtgaatagaatgtacttcccatgatgtgaaatacacttctggcagataaaatgcaggttgtaatttgcatttgtacatcacagggtaaaagaatggccatccattctgaggaagagtgttctgttctctaagatgctgcttaaccaatgttatccaaatgccatagcatcatatctccaaatacaagattaaatcataaggattcatgtaaaacagagtatactgagctgttctcagaaaaattaatgatgtgtttattgtaaatctttattgcacagatgagcctgacagtccttcaatgtataattttcccccagcatctagtaatgcataagtacttgtatgttcttctgattaccaaataaaaacaatgagttaacctcttaattggaattggaaaa

SEQ ID NO: 47553 - DNA, 911 bp, Homo sapiens
cgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatgggcagctgtgacttctccatccgcacctacacctatgcagacacccctgatgatttccag

SEQ ID NO: 47554 - DNA, 892 bp, Homo sapiens
cgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatgggcagctgtgacttctccatccgcacctacacctatgcagacacccctgatgatttccag

SEQ ID NO: 47555 - DNA, 1028 bp, Homo sapiens
cgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgagacggggtttcaccatgttggtcaggctggtctccaattcctgacctcgtgatccgcccgcctcggcctgccaaacagctgtgattataggcgtgagccaccgcgcccggccaaccatcattattatttttaacgagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatgggcagctgtgacttctccatccgcacctacacctatgcagacacccctgatgatttccag

SEQ ID NO: 47556 - DNA, 279 bp, Homo sapiens
gttgtgtttttcattttaaattccaattgttcattgatggtatatagaaaaccaactgacttttgtatattaatattgcttattagttccagtattttttgttgttgttgttttttgtcagttctctgagattttctacgttggcaatcatgtcatctgcaaacaaagttttatttattctcaatctgtatacttgtagttccttttcttgctttattgcattagctagggcttccagtgtgacatggaataggagtggtgacaggtaacattcttgtc

SEQ ID NO: 47557 - DNA, 383 bp, Homo sapiens
gtttaaaagttagggctgcccagatcccacctacagagattctgatgtaaatggtctgttgcagggaggggactccccatatgtttctagagtgcactcaggtctgacagccactatgcgggatgaatctgaaatctccctcaagttcttataccacgtggttctttattaattatttaaggaaatgatgtttttcctttgaaggcatcaaaatcctacgtgaataaaattttaattttttttaaatttcccgagaactataaggatcgaaattatgagggcagggacagtgttgcttaaatcatgaattagtgattcactgataataatggttttggtgaccagcaagaaggcaaacacatggcaaatgcagcaagtgcagg

SEQ ID NO: 47558 - DNA, 427 bp, Homo sapiens
ggtcccatctccgcctgcaaaaggagcagctggctccaggctccaacgtgccttccagctgcctgactgcctcttcgcctctcccgtcatttcttggctcgaaatggaccccaactgctcctgcgccactgggggctcctgctcctgtgccagctcctgcaagtgcaaagagtgcaaatgaacctcctgcaagaagagctgctgctcctgctgccccatgggctgtgccaagtgtgcccagggctgcgtctgcaaaggggcgtcggagaagtgcagctgctgtgcctgatgtggggacagccctgctcccagatgtaaacagagcaacctgcacaaacctggatttttttttcatacaaccctgagcatttgctacattcctttttctattaaatatgtaaacgacaataaaacagttttgacttga

SEQ ID NO: 47559 - DNA, 994 bp, Homo sapiens
  misc_feature (435)..(435): n is a, c, g, or t
ggtcccatctccgcctgcaaaaggagcagctggctccaggctccaacgtgccttccagctgcctgactgcctcttcgcctctcccgtcatttcttggctcgaaatggaccccaactgctcctgcgccactgggggctcctgctcctgtgccagctcctgcaagtgcaaagagtgcaaatgaacctcctgcaagaagagctgctgctcctgctgccccatgggctgtgccaagtgtgcccagggctgcgtctgcaaaggggcgtcggagaagtgcagctgctgtgcctgatgtggggacagccctgctcccagatgtaaacagagcaacctgcacaaacctggatttttttttcatacaaccctgagcatttgctacattcctttttctattaaatatgtaaacgacaataaaacagttttgacttgaaaaaaaanacaaaaaaaaaaaaaaaaaaaaaaaaaaaaaaaaaacaaaaaaaacagcaaaagaaacaacaaaaaaaaaaaacaacaaaacaaacaaacaaaaaagaagacacggcgcgcgtagcataaggacagcgcgggcacagcaacacgagcacacgcaaacagaaaagagagaaaaacgaaggaagaaagatataaagaaaaggggaaaggagacaaaaaaaagagatagagaggacaaagaaagcgggaggtgaaaaatgacaggaaggagaaagacaacggtgaagaacacggggagaacaccgagcagaacacgacgtgctagagagtggtcccgaggcagccgccgaccagtgcgagaagcacacaaaaaggcgggtatcgaggagatcggagacaaccagggcacggggcgcgcgggccagcgaaagcaggcagctgcgcggactaaagagagggacaatagagggcgaacaggcgctagcgccgctcgggagctacttgcttcagatggagcatttagcgaacatctggcgatctccgatctgtagcatgtgccggt

SEQ ID NO: 47560 - DNA, 912 bp, Homo sapiens
gcggccgcctactactactaaattcgcggccgcgtcgacctcgaaatggaccccaactgctcctgcgccactgggggctcctgctcctgtgccagctcctgcaagtgcaaagagtgcaaatgaacctcctgcaagaagagctgctgctcctgctgccccatgggctgtgccaagtgtgcccagggctgcgtctgcaaaggggcgtcggagaagtgcagctgctgtgcctgatgtggggacagccctgctcccagatgtaaacagagcaacctgcacaaacctggatttttttttcatacaaccctgagcatttgctacattcctttttctattaaatatgtaaacgacaataaaacagttttgacttgaaaaaaaaaaaaaaaaacggacgcgtggggcggggcgggcaaaggaaggcaggggggaagggacagtcggtcgcagaccgcgctgggttgccgcttgccgttgccgccatcgtgccagcccctcgggtctccgtgaggccgggtgacgctccagaatggggagacaacgccaatttggggagcagatgggatccagcttcattcaacatttactaccagttttttgatattgatagaacccaattaggcgcaatttacattgacgcgtcatgccttacgtgggaaggccaaccgtccggcgaaagctgccattgtgggaagttgtctagctttcgttccagaaaattcgcacagcatcaccgcgccaggaccatcagccactccggatagtggctcatcagctggttgtggggccgcttaggggtgaaacccatctggggttcccggtgttctttttagaactcacgcgtggggttccccctatttttgggcccgcacattggggccctccggggcccggtccctccctcccattcgctcgtct

SEQ ID NO: 47561 - DNA, 387 bp, Homo sapiens
ctttttcaatgtggtcaatccagatatctgccttacacaacagatatccaccaccctctcggacagagagatataacctacttgacttgccccactgaccctcatacccaacatggacaatgcaaatatgccacagtgatcacctctcagtgatggtgtgacctcctggaactcatccctacttgcttcaaactcaccagtttgaactcctcataggaaacatgtttgggtaatggctttgatcacaataaaggcccagcctgcaggtctgtcccactcaacacccattggttacgcatcctgctgtcttcagacttctcatcagcccttgtgggcaaccctcttctcttgtagatctgagtaataaaaatattttgcatttcatgt

SEQ ID NO: 47562 - DNA, 246 bp, Homo sapiens
ccaagaggaacctttaaatgaaatcatttccatggcagagttgggggcaagagagggagttggagttgatttctcatcgtgtgaatcccactccatcagcacgtggaaactgaggaagagggaaggagtggagaagaaccagacgagagacacggttccagatgctttcccaagtggctgtgccctcctcctatttgcggaggaatggctttggtctgcacctgcagctctggacggactgcctgg

SEQ ID NO: 47563 - DNA, 437 bp, Homo sapiens
cacaaacttaaaacctggcatcatcataatctgaggttatctgatcatagagctacaaaattagctgcttaattattatatattcagaaaagtctgaactttggattgaatttaaccctgtgaagtaaccagagatccagtccttttgcatacataataccagactcccatgtgtatttaaaaaatgggaaaacctagaagtgttactctaaataagataaaaatgatgaaagaagaagaaaagccacaatagggcagctaacaagattcctagagagaacccaagtaatttctaagtgaagctgctcaagtcagatttttctgccagttcggtttgtctttttctttttaaacctttttcttttctttcttttttttttgagacagaatttcctcttgttgcccaggctggagtgcaatggtgcgatcttggctca

SEQ ID NO: 47564 - DNA, 417 bp, Homo sapiens
aaaagccccttgcaagcaacagtgaaatgggcatgcttaagagctcttattaagcacaattcttgagagccccactgaatttctctgctccttgtaagacaggacactggctacctgcttagctactgttgtggggatttaatattaaaaatatttgacatggtaccttgtttatagcaggccctcaatacatttaatcatttaattcccttcccttcccttccctcttttgaatttcaagagggaattaactagatctagagtttatttgatacttgtgggaaaatcaagggttacaactggtttggagttctaaggatactcaaagcctttaaacattatcccacagttcctgctaatatgggcacaaatagaaactttcactgtttacctttccattcattcaacaaatgcttg

SEQ ID NO: 47565 - DNA, 471 bp, Homo sapiens
gtcatttaaaaaacaaaactcaagcacagcttgtagcacattgagttattgtatggtcaaatactgaaaatagaacttgcagcactttttatcctaagatgtattcatcttgtgttaggttattattacccattatgtcaacaaatatttctaagcattaaaagttcattgtatataaacaaaatacaaacatatgggccaggctcagtggctcacctgtgtaatcccagcactttgggaggctgaggtgggaggatagcttgagctcaggagttcgagatcaaccctgggtgacattgcgagaccctgtttttgttaaaaagaaagataggaagatttgtgtatgtataacatgatcacaatcaatcatatggtcattttcagataatatagaccttcacatatacatgactgattacctgtaatgctgtatttctcacctaaaaagagacaagaaacaatttttaaaag

SEQ ID NO: 47566 - DNA, 461 bp, Homo sapiens
caagacagtagaggatagttaaaagttgttaggttaaaaatttaagattgtagaaattataagtattaaactggtataaagaaacacccaagactgggtaatttataaagaaaagaggtttaattggctcacagttctgcaggctgtacaggaagcatggcagcatcaacttctggggaggcctcaggaagctttcaatcatggcagatggcaaatgggaagtgaggcacttcacatggccagagcaggagatctaatcacctctcaccagggcccacgaccagcattggggattacatttcaacatgagatttgggtggggacacagatctaaaccatatcagatgcccagaactccttcactgttcatgtcttgctctcagagcaggtgggaggaatcactattagtgaaattaatatcaatcaattttccactcatatctagttcttataaaggtcaa

SEQ ID NO: 47567 - DNA, 395 bp, Homo sapiens
gagcctgtgagggctgggagtcagcagagctatcaccctctgcgggaagaacaagacgggaccacactgcaaaacttcctggcagactctcatgcagtgaaacattccaccaacctacctacttatggaggtctccacccgggagaaatgaaaactacgtttacagcgaacttgagcacttctgcatgagcagcacgtgatggacactcagcagtaaaaggaacgaaggtggctgaatcccaggtgcagcctgcagagggacagaagccaggtggaaaaggctgcgatctgcgactccttttatacgacgttctaggacaggtgagcccacagggcagggggcttcccagtggctctgagggctgaggtgcgggcagtgattgaccgcaagggac

SEQ ID NO: 47568 - DNA, 742 bp, Homo sapiens
agtggtttcatcctacctgaaaattgccttcttgaaataaatgtttgatacccactggcctatctcctctggaaaacaggagttttcatttagaagtccagttggttggattccagtaagccgtttcacctgactgtattacgccccctggaaccagggctgtgcaggagccaccggcttctcccagagggcagggtgagcacagtatcagggcacatggcttaccctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggcactaaccaaaaaaaaatgcggccgaattcaagctcacttggccaatccccctttgggaagcgaatacaatattggcccgctttaccgtg

SEQ ID NO: 47569 - DNA, 256 bp, Homo sapiens
ctgtatgcccccctgagagagacagtgatgaaggaaatgtccgactccttctccagagcacagtcttgttgagaaatttgagactcatgcccatgaacgtggtcattgcctcagtcgtcctgctgatattcatttagcagcgcgttgggggtatgttgtgaaccgggcacggtccctactctcagggcgtttaactctggtggggaaaacgttaaacaatgacctcactaatacatggaaatgcctcctactgctg

SEQ ID NO: 47570 - DNA, 809 bp, Homo sapiens
ttaaaaaaaagaaaaagaaagcaagaaaaaatgatactgtggggtcaagtataactccatggaaatgccacgtctgctcttcagtgaagaagctggtttagagtctcaaagaaaacttttgactgtatttatttattgttgcaaaaaagacgcttttttattgctgccctcatttgtcagctaagtattttttcttataaaatccagccccggttacatataatccatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagaaaaaaaaaaaaaaaaaataaaaacaaaagaaagagaaaagaaaagaaaaaaagcaaacaaaagaaagaaggagaaaccgaaaagaaaaagagagaagaaagaagaacagcagaaagaagaaaaaagaaaagagaaaaaaagcaaaagaagaaaaaagagaaaaaaagaaagagcagaacaaaaagaggcgaaagaaacacata

SEQ ID NO: 47571 - DNA, 216 bp, Homo sapiens
cggcaccttcttcaggaggttgaggtgacctggaaggtcacgctgatcctcccaccgccccacagggtctctgcgtaccccctctacaggctggaatgtttggcctgggtccctggccctctgcgggcctcggtttcccctcctgtaatacttgtaagaactcagcctctccctgctcatctacatggtgctggggccactaaacagacagggagt

SEQ ID NO: 47572 - DNA, 364 bp, Homo sapiens
tgacttttgttctcagtgtttctttcaccatttatccaacctatccccatgtgtttttggtatttttttttctttttcaggtaagagtttaaatccaacctcctttatcaagccccagtttatgaaaactttctagattcaccagtgttaacactaaaaacataccaacacaaccaaaggaaacacgttgtcatgaatggtgaaatacttctaccatccaatttgcccagagttttattcccttgggagagcttcttaaagatctaggaagtatcttttgatgtacataactcagagattaaacacacttcacaaagtataggtaggctccactgaaagaaagctcgaaaatttgactgtaaaa

SEQ ID NO: 47573 - DNA, 394 bp, Homo sapiens
gtcttgattggcccagaaaacattcagctgtaatgatgaaagaaattaagcactctaaagaatgaatcaaatgctttcttatctttaaaattataccatatgccttaaacaggatgctttataaatatataatccagtgattgtatttgtaacttgtaataggcttagttttccttaaattgatacacttcagcatacaaaacttccttaagaactttatgtttaacttcagtagggataaaaaattttttgtggctgtgagtaatgtttacattttgagcgatatgatttatatgtaatattagtggctataactttgtattttgatggggtcaaatgtttgaagttttactagtttaataaatatatatatttttaatgtagttttaaggac

SEQ ID NO: 47574 - DNA, 614 bp, Homo sapiens
ccaaaagtacttttagaccagaatttatggtttgtacattataaacctgttaaaaaatcagctggaaggcttgttgaaacagtgtcaggccccactcagtttctgattcactggatctagggaggtcctgagaatttctatttctattacagtgccaggtggtgcccctatagctggttccagaatctcaccttgagagtcactggcctccaggattaagtctcagctcagcttcacagtatagtgctcaagaccttttctggtctgacctcacccatgaggtgtcagttctcctggaccagctctaagctggcttgcacagagtgtcaatctgagctccttgccctcttgaactgcagttttagggttttgatatcttgagtgacttttttcacccaaggcaccaaacaagtggcaaactcctccctgcttctcatggctcgaggaaagagcttctccagtcttccccgcactggctgagcacggagagtgatgggaaggaggggatggtgggagagggagggcaagggggcctcagagccttgtaccctgtccaggctgctagacttatgcgtgacattttgtaccacatagatcatgaataaactggaacc

SEQ ID NO: 47575 - DNA, 236 bp, Homo sapiens
atacttggaagcaaatcatagttttatttctttagtgtaaaggaaatttgaggtcctgggatacagtaggtgcccaacaaatacttaacctcttcgtaataatttagttaagttgttactacaaacagggaatgatataatgatcagaggtgaaataaatttgtgagcacctcctccaacataaatctcatttcagattcagtaaacacttatcaaacgtccacttgtgctgacag

SEQ ID NO: 47576 - DNA, 510 bp, Homo sapiens
atgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctcaaattgtg

SEQ ID NO: 47577 - DNA, 863 bp, Homo sapiens
accagttctacttaaactattcccaaaaattgaggaagtactcgattgggaggtgactcgataggaaggtacccctccctaactcattctatgaagtatcatcattttgataccaaaaactgacagagacacaccaaaaaaagattactttaggccaatatccctgatgaacatagatgcaaaaatcctaaacaaaatactagcaaactgaattcagcagcacatcaaaaagctaatccaccatgatcgagcaggctgtatccctgggatgcaaacttggttcaatatacacaaatcaataagtgtgattcatcacatagaactaaaaacaaaaaccacatgatcatgtcagtagacacataaaaggcttttttaaaaattcaacatcccttcattttaaaaacctttaacaaactagacattgaagcagcatacctcaaaataataagagccatctatgacagacccacagccagcattatactgaatgatcaaacgctttctagcttctgcatttcctttgagaaccagaacaagacaaggatacccactctctcaccattcctatttgacatagtaccagaagtcctagccagagaaatcaggcaagagaaagaaaaaaaaagaatctaaataggaagagaagaagtcaaactatttctgtttgcaaacaatataattctatacctagaaaacctcatactctttgcccaaaagcccctagatgtaatcaacaacttcagcaaagttttagggtacaaaatcaatgtacagaaatcagtagcatttctatacaccaacaaaatccaacctgagagccaaatcccaaagaatgcaaccccattcataatagtcacaaaaag

SEQ ID NO: 47578 - DNA, 565 bp, Homo sapiens
tactggcgagtgttgtgacagcttaaactattacgacttataaatagaggagcagtggtgttggcagcgtcagggcatggcccaggcaggagcagcggccacagcgttcatccatctatggaggaagaggctgccttggcgggtcaactgtgttgctccaagtgacataatgtcatgattttgatagctgaagtgttttgccttgtgtacatactagagtttcttgatgtcttcatttgtggatggacaggttcatttgtgttgctccaaacaacaaaatttcattattttggtagccaaaaagcatttcccttcagtatatataccagaatagtttatgctgtcagcataaactattgttgtgggggcgggtatgtctgtatataaatctgtgcagccactagtcaacaaatactgtgtatgcctagcacttcctagtctagtccacagcatctgtgggtttaaccaactttgcatcaaaaatattcaaaaccaaaattgcatctgtgctgaacatgtacagactttttttcttatcattatttcctaaacaatagatatattt

SEQ ID NO: 47579 - DNA, 587 bp, Homo sapiens
tctccacggggcccccccatcatggacctcccctcccttgctggagctagaatgagggggaggccgccttggcgggagccttagagaggaggaggaaagggggagaggaaattgcagacatagctgaaggcgctgcctgaggcctgtgggccagcgaccctctccctgtccgggctgcagacccctactcccccagtcccgagactgggttcaagtagagggcagatctagatgggggaggactaggactgactcctatggggatggaaaagggactcctgggtgtctttgtgactgtttagtgtgttctgtgaatgtgcgggcaggtatttttgcccacatctgtatatttgtctattaatgtgatgtatttgagtattgttgtgggggcgggtatgtctgtatataaatctgtgcagccactagtcaacaaatactgtgtatgcctagcacttcctagtctagtccacagcatctgtgggtttaaccaactttgcatcaaaaatattcaaaaccaaaattgcatctgtgctgaacatgtacagactttttttcttatcattatttcctaaacaatagatatattt

SEQ ID NO: 47580 - DNA, 306 bp, Homo sapiens
tctccacggggcccccccatcatggacctcccctcccttgctggagctagaatgagggggaggccgccttggcgggagccttagagaggaggaggaaagggggagaggaaattgcagacatagctgaaggcgctgcctgaggcctgtgggccagcgacctggacttcaatgtgtgccatgctgtgcgagctgtcctgctccaacgactaccggatgcgctgagtgcccggctctcccgccctgcaacgagcccagtggctgagcgtaccatagtgctggttcagggggctcccacttcctctccct

SEQ ID NO: 47581 - DNA, 2284 bp, Homo sapiens
gcgcctgtcattgttcacacagatttattaagatttcatgtggagacggttgtggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccagggtatctagcatggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccgggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaagacgactcagtatacaaataaagactggaaagtcctatattaaaggaactagttaaatactagtttattttacttaatctagtgaatttttaaatattttctttctttctttttttttttttttttttttgagacagggtctggttctgtcaaccaggctggagtgcagtggcacaatctcagctcacctcaacctccacctcctgggctcaagccatcctcccacctcagccttctgagtctgggactacaggttcccaccaccatgcctggctaattttgtattttttgtagagacagggttttgccatgttgcagaggctggtctcgaactcctgagttcatgcaatctgaccaccttggcctcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgcccgacagcgggctttcccttctccttcagagcagtagcagttccctttcttcattcccacccatcacagtggcagccccctctgccctcctgtattctgaatcccacccttataatatgcttagattttgcctttctcccagccgttttgtgagcattgttcgtgtgtaccaattttttctcatcctttaaaaagaaaa

SEQ ID NO: 47582 - DNA, 1907 bp, Homo sapiens
gcgcctgtcattgttcacacagatttattaagatttcatgtggagacggttgtggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccagggtatctagcatggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccgggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaagacgactcagtatacaaataaagactggaaagtcctatattaaaggaactagttaaatactagtttattttacttaatctagtgaatttttaaatattttctttctttctttttttttttttttttttttgagacagggtctggttctgtcaaccaggctggagtgcagtggcacaatctcagctcaccagggtttcagctgtctaacctgaatcaatctggccagccttagtaaaagagaatgggaccacaggtttcccacaacttgagtgctaagttttgaatatttggtaaagcagggtttctcgattttgagtagacttgtcttagcggccccttaaggcaaattagcca

SEQ ID NO: 47583 - DNA, 1680 bp, Homo sapiens
gcgcctgtcattgttcacacagatttattaagatttcatgtggagacggttgtggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccagggtatctagcatggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccgggtgtggtggctcacgcgtttaatcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgcccgacagcgggctttcccttctccttcagagcagtagcagttccctttcttcattcccacccatcacagtggcagccccctctgccctcctgtattctgaatcccacccttataatatgcttagattttgcctttctcccagccgttttgtgagcattgttcgtgtgtaccaattttttctcatcctttaaaaagaaaa

SEQ ID NO: 47584 - DNA, 374 bp, Homo sapiens
aagggaagggcctaagcgtaggtgagggctacacccgtgaagaccgccatcttggcttcatagatacaaccttggatgcacgttcacattgtcattactttccagtcacatttccacccagctttttccatcaggcgacaaacagtaaggtgatggtaacgttgaggctacccgccctatgtggggttcatgacaacacctgtgagacatacacatgcttctcttcttagcttccaggtgtcaacatcgactctgatcacagaactggatacactggcctccttctgaatttagtcaccattctagtgttaccatcagactgcaaggtaaagcactcctaaatagccaacaccgtaggtggaaccaactatgcc

SEQ ID NO: 47585 - DNA, 1526 bp, Homo sapiens
taagagtttgagaccagcctggacaacatggcaaaaccctgtctctactaaaaatacaaattagccgggcgcactggcacatgcctgtgttcccagctactcaggaggccgagctgggaggctcgcctgagcctgggaggttgaggctgcagtgagctgtgattgtgccactgcactctaggctaggtaacagagttaagatcctgtctcataaaaaaaaaagtaaaaactatttttagcttgaaagtttctgagcctcaataggtactggctgaatgaatttggcctgtgggctatagtttcctggcaccatgaatttgttttcttttactttctctcagtaatgtcatataaggttttgtgttgtggtcttacatatctactgttagttatgtctaacccctagttttctagttctctcctcagttgtgcctaagctgctgttaaagcattccagtgaactttagagacaggggctcactgttgcccaggcttgagtatagtggcatcatcatagctcactgaagcttctaactcctgggctcaagtgatcctctcacctcagcctcaaaagtagctgggactacaagcaggtgccaccacacccagctattttgttttttgtggagacagggtctcactatgttgcccatgctggttccactgtattttttcttttgttgagacggaatctctccctgtcccaggctggagtgcagtggcacaatctcggctcactgcaacctccgcctcctgggttcaagcgattttcctgcctcagccttcggagtagctgggattgcaggcgtgcaccaccatgcctggctaatttttgcatttttagtagagacagggtttcacattggccaggctggtcttgaactcctgacctcatgatccgccggccttggcctcccaaagtgctgggattatgggcatgagccaccatgcccaatcaagtttccactgtattcttaattttgattattggattcttacaaattctagaatttactttttaaaaaaacatgttcatgtagctgctgaattcccaaactagtgtctctccttgaacatggtaagcagttattttagtctgatagcaccgatgtctccagccactgtgggcctgctatcttgtctcacgtgcctggttacatcttgttgtactcaggatattgtattagcaaaattgtagaaagaatctgggtttaggataataataacatcctctagagaggggttttgtttgcttatccaaagagtttgggcaaactaccactctgggatcaccttaatctaatttcaaggattaagatccgtaatcggaggctgggctgcagtcccgagagcctgtttcctacaccgcctcacccttattcctggggtgcaaaagactgagggcttcaaccaaaagtgagtaacaccaccaagtccatcgccctttcacaggccccatcccctacttctgaaaggctgctaaaatcactgctaagcctctgaatcacctccaagtttggcaaatg

SEQ ID NO: 47586 - DNA, 562 bp, Homo sapiens
ggagccacgtccaagtgtgttcttcccctaagaggccaatcatctttctctctcttttcccacctcaatccttcccttccttcccctcctgacctgtctgaattcccatttgcaccagtttccctttttcacagacaagacaagattccctcagataactaagccattccctggccatgagttactacagtttcggtcattcattcagtggaaaagcgaccagggacagaaggcgccgccataaaggtcacctggcccgagcagacgccaggtcgctgcttcttccttggctgctgacattttaacagcggcccagacagtctgtttccgctttccccaaacaagcaccctggagaccctcccccgacggctcgaggcgagaaacagggcctggcccaggagccggtggccgcgacctcgggtctgcagtggcgccctctgcaccttgggaagcgcccgacgcacaggacagggaccgggcaggaggcaggggcggccccaggagaccgggcagcggacgggggagaccgcgggggacccggaaggggatgggggcggccgc

SEQ ID NO: 47587 - DNA, 1985 bp, Homo sapiens
cggcggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaaggtgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcggaggaaggcagacacccacaagaagatgactgagttctagagaccccacaagcactatggacgaagcgtgggaccccagcacgggctgccctcaggaagaccagtgttgcccgaggaggggccggactgctggcctggggcgtgcggacactgctgagtggagacagagctgcggggtcccatctggacacttacttgcccacctgccagtgtcttgggcatttccttggcaaggacattaaagtgatttcatcacagtgtc

SEQ ID NO: 47588 - DNA, 1915 bp, Homo sapiens
cggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaaggtgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcggaggaaggcagacacccacaagaagatgactgagttctagagaccccacaagcactatggacgaagcgtgggaccccagcacgggctgccctcaggaagaccagtgttgcccgaggaggggccggactgctggcctggggcgtgcggacactgctgagtggagacagagctgcggggtcccatctggacacttacttgcccacctgccagtgtcttgggcatttccttggcaaggacattaaagtgatttcatcacagtgtc

SEQ ID NO: 47589 - DNA, 391 bp, Homo sapiens
ttcccagctggaagaaggaactgagggtcccatctgtagctatttggcaagtggatcataggcccagaaggaagtaagtctatccaaactctccccctctctcttcctccaagatcctgccctggcctatgtggctctggcccatgatttaggacttcaggtgtgtggtttttttacacttggtccggttggttgcggacagggagaaaagaaactgaataatgattgctgtttaaccaggaaagctgtgacaaactcagctacagctcagcatgttttacctcctccctttcactcccgcaaacagcaatgagcagatacatttttactgcaaagaatgactgttaagtagttaggaattagaagatgtgtttgccagagagaagccttc

SEQ ID NO: 47590 - DNA, 709 bp, Homo sapiens
atccccagtgcggcagtgttgggacatgggtaggtcgggagggctctgccactgccattacaatgaggtaatatccttgtcacctgagagtggtttttgtgaaggccggtgtggggctcctcttgctggcttgctctctggctctctcgccctttccccttctgccttccaccatgggatgtcctagcaggaaggccctaagcagatacaggctgttgctgttggactttgcagcctccagaactgtcactccaagaactgaggcccctgtcagcagtgtcagtaatagttggagaatgccctgcacacatcagcacattccacggaggagtcgctgcccaagaggcccttaggaaaacacagcaaagtgagtgtgaaaagatagacctgaagggattatcacacacaaaaaatgacagaaatgttgaatgttcctttgagctatgtcagctctatcctgaagagaacttggagaaactcattccttgcttagctggtccggacgcattttatgtggagcgaaaccacgtggatctggactcaggcctgaggtacctggcctcattaccttctcacgtgttgaacaatgaccatgtcaggaggtttctcagcactttcctctcccccaaaggaggttcagagtccaagtcctgggaatccctcccttctaaagtaggtacgcgagggcgtgtctggaagcctgtgtgtg

SEQ ID NO: 47591 - DNA, 325 bp, Homo sapiens
atccccagtgcggcagtgttgggacatgggtaggtcgggagggctctgccactgccattacaatgaggtaatatccttgtcacctgagagtggtttttgtgaaggccggtgtggggctcctcttgctggcttgctctctggctctctcgccctttccccttctgccttccaccatgggatgtcctagcaggaaggccctaagcagatacaggctgttgctgttggactttgcagcctccagaactgtaagaaatacatttcttttctttataaattacctactctgtggtattctgttacaggaacacaaaacagaccaagacac

SEQ ID NO: 47592 - DNA, 263 bp, Homo sapiens
attatctttcatcagatgaaagagtatttgcctacacattgccaatattcatccagatatattttgggaaaaaaagctcttcaatttctcaagcacttttttcatcttttgaactggaatccaagtcatggaggcccatcaccttacagcttcttaaatggcaaacataattattctttgattttgcttttcctcaggctgcattcttaagtaatttaattttccttttgttatatgtgattggcaacaatgcgcacaatgag

SEQ ID NO: 47593 - DNA, 165 bp, Homo sapiens
attccaccctgacctcagccctgctaaatcctggcaacttacctgggagatgctacttcccgactgtgtgtccttgaacaagtcattcgatctctctcatcttccgttttctcatctgcaaagagtcggcaatgactcattgggtcattgtgagatgtggccgtg

SEQ ID NO: 47594 - DNA, 450 bp, Homo sapiens
ctccttatctctgtgcttctcttgctgtgtaggcttgctttcttcgcatagaaggcacaggaccagtggcctctgtacctcacagcttcaagagcagataggagggagctcttccctttgccccggttgaaaaacttcctgggagatgactctgtcctgccctgtggggtagtgggtcctgtgattggtcagcttcctttatcagaaaaggctgtgtctggtgaaagcagtcacaccagcttccctatagccccgcattaaagctgagtggagagagggagggagagggccctgtgctattgtgaaagaggataatttgatgctattacagctcagataaggtctgggagaatgatttgccggacaggcatctccaactgtgcaactcagccacattttacatatgtaacactgggtaacttacttgatatccctagtgtcattttcatt

SEQ ID NO: 47595 - DNA, 305 bp, Homo sapiens
aaaaactccaaagccatttcagagatcttcaagactgcccctcccattactggcccagagctctaagagggcagaatggtttggaatgaccagctgctgcccagggctgccttgggtctcatctccccacatttctggtgcagcattcctcagccatcccagctgtggttcaggtggccacaggtgtgatgtggaaggtaaaagtcataaaccttggcagcatacacatggcactaattttgcaggtgtgcagaatgcaaaagctgagggggcatgccttcttccacctacatttcaaagggtgc

SEQ ID NO: 47596 - DNA, 403 bp, Homo sapiens
cttgggcatcacctgggatgtagtttttagaacgacagggccctacccagacccactgaatcagaacctgcagacccactgaatcagaacaagtcctcagacaatgcatttgcacattgaagtttgaaaggcattgatctaccttaaggtcctgccaaaacatcccgcctgctctgttgataaccttgttgtgatatgaccctcagaaatgtacccatggtgaatgcttctgacatccacatagctgtgagtatagatgcatgccactttgtcccgaatgtacttcattattaagtgcttagtgctgagctgggcacaaaagatacaaaaacaagtaaagcatggttgctgccttcaaggagctcagaatgcagtgcgggacacagaaagagctgcagcatcc

SEQ ID NO: 47597 - DNA, 790 bp, Homo sapiens
aacttcaatccgctataagcaaagtaatcatgaactgtaaaataccaaaacctttagactaatacaggagtgattaatagtacctacatgtatgccatttagcaatttctgcaagtggaattaggccttaaaatgggtggccgtgttttcagcctaccacttttaaataccgatgactgccatttattgagtaactataattacaaatattctgaatactaggatcagcaatctttacagcaatgtggaaagatagctacactgtattatcattgtcattatagacaaggaacgaagacacaaaaaatattaagtaacttgcccaagacttctacttaggtaacagagcaaggattccaaccaaagaccagtctggcctcaaaaactctggtcttttcattattctgtgttatctcttcctaaaacaaatgaaatcatccaatcatcttagcttttagattcaaacatggcacataattgaaactgcttcacccaatctggtatgttagcctgggtttagaacctttaataagccagtgatcggttggcaatggaaagtgctgggattgccagccagtcagatctaaaggccagctgggtcatggcagggctgcagccatggcaagactcctccaaagctcatgtgggaagggagctgaataggcttcctgagcttttcagttgaacaactaacatctactgtgatgccaagaatttaagaacatgaaaggtggctttttcttggatgtggcttgggatcttttttaaaaaaaaaaagaaagaaagaaaa

SEQ ID NO: 47598 - DNA, 518 bp, Homo sapiens
tttaataacaggtttttagacaaatattcaggaaaaaacaggaggtataaattccagggtcaaatggaaatgcagagttacacgggtttttattttgttctgttgattgattttttaaaaaatgaggtatttctgagagcctctagtatgctagcactgattgtgatctgtaaaagcatcttataatatgcagtgctcccaaactagtaaactcttctgctgttttctcccctaaagagtcttgagttctgcagaacacgctgggtgttacttcttgggatagctggtactgtagtgtgccctgctggggacaggttctcccttacctaagggaattctcactggggctggggacttcccacatctgttatgacacttgggcactgacaatgggggttgcagaggttctcagggacaggctgggttagcctactccctcacccttacaagcaactctgctctctgtggcactcatcagaattgctttgcacagtggtctccaactttttttttttttt

SEQ ID NO: 47599 - DNA, 1484 bp, Homo sapiens
agaaaatgaacttaatgaaaaaaattataatgagcaatgacaatattcctataaaacctccctctgggtatcaagagacatattacctgccaaggccagattttactttttaaggtttcctctctctcaccaaagacactagtgggcacagaggtgacactagagttagaatgttaccagagtcatttgcattagacagtttatctgatcatgaacatgttcccagggagattagaaaaatgggaagcaggcctctaaagatcctccttggacatttgtaaaaaggctggctgcttctccaggaatgtctgaattaagcaagaattgtgccactgaaatagcttcttgtttttatattaaacaaggaacgattgtgcagtggatgacctggactgaaagatgtatgatggtcaagtttaaacatattaattcctgattgttttcttaaatacccaccctagtcattttttggaaaatattgccagacatatttgacatgaattcatgtttattctggcttctgttcccaagcagaagtggattaaccctggcaatggctggcttcactaactgtacttgcacccagcctgggctgccatctgctcagccaggagaagcagggagtggggtgtgggccctttaagttcgctcagggcacactcattcagtctcccctgaggagaccttgtccccctttgtggggtgaatgctggctgttgcaggccagaggcagtgccaactggagactcatcctctcagctttggtcagcttcagccacgtattcttcatgagtgctggcttctgaacctgcaggatcatttctcagtcagtttatggtgcagggtaattcatttaaaataaagcccattaaaaccccatggctatagaatgggttttaaatagattgtcctggagacacatcattgtatagtctttgcttccctctcatgacctatcttggagtagaatttgtgtactactgtccttgtctttgagtgggtatatgtgtgatggtacagaaatacagtcacatattatattaatatatatagatggataggaaaaacctacagccataggtattgtccaataactgattctagaggtagaactatagagtatacatttccttttttcttgctttgatgatatttttatacaattttatatgctataaaattttcaaaaatatatttgctattttcatttgtagagcttggttaggtttttatcagctcttgtgcccactgtacaaccagattcccctcatctaatttaaatgtcttccctttttcaaactctcctttatgttttcctttttttttcctcccatttttctacccttcacaaattccttcttttgcttctgtccaggtaacccattctgcttgcagtatcattttagcacgtacaaacacaaaataatgggaaaaataaaagcaccttgttccatgcaattcgtatgggaaagttttgggtgtca

SEQ ID NO: 47600 - DNA, 3320 bp, Homo sapiens
ttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacacctgagctggctacggagcagaagcctatccaggaccctcagcccacaccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccct

SEQ ID NO: 47601 - DNA, 3194 bp, Homo sapiens
ttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacacctgagctggctacggagcagaagcctatccaggaccctcagcccacaccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccct

SEQ ID NO: 47602 - DNA, 3068 bp, Homo sapiens
tcgagctcggtccctggtttactcgccaagaacgtcagaacgactcaagtgcgcgcagaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacacctgagctggctacggagcagaagcctatccaggaccctcagcccacaccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccct

SEQ ID NO: 47603 - DNA, 476 bp, Homo sapiens
ttctttgaagatctgtgctggtctttcggtcatcctgccactatccccaagcagcttccatatctgtcatttcagggcagcaaatctgctgacattaaaagtaaaccaactaagttttcaaacacatcttagtccccaaatccttcctccagtcatgcagatcaagtaaatgtcttatctttatgaagtcgtggttggcttcagcttctccaattctggcgtttgattctagatagaaggttaagtaccccctgttgcacatcagacttgcatcaattcaatccatttgctgttaaagaagcatcacacttcccagaaaggtttttttcccctttagccacataccaagccagaatcagacaaatgcagcctgaagtatttttagttattattcacatttgtcaacagggacagtgacaactcaccagtccgttctggggcagaacttaaggaatggaactctcgtatctatattg

SEQ ID NO: 47604 - DNA, 832 bp, Homo sapiens
tctctagaaaaaaaaaaaaaaaaaaaaaaaagcagattctaaactcacagtgctgctgctggctgcctgagcttgtgtggctttggacagatgacttaaccactctgtgaagatggtatctgatgcacaggaaatgctccaacgttggctcttgtcgtcatctgtgcccatgtctccctcagcagcctcctgactggccttctccagtctcctggtttggattgaggctccctagaccctacctttctgagactggtatctagtcaggttactctgggagatctccaccccccactgcccagagagcaggttctgagctcttcagtctctccaccttctggccccggctgacaccaatccctgccacttctcctggggtccccaaacatctgtggtacttttgtctttcttgcccattggtgttccccactctgcagaacaaccttctctccaggtcaccactgatcgcaatcgcgctctcctttcaaggcccagatcaggtgtcacctgacctttgctgtcctcagatcacacctccctgtagcgactggctcgccagtgtccctctctgaccgagctgtgcactcctccagggcagcactgtcagggtctcccccagacccttggttgtgattctctctccttgtcctgaatctcagttttcctgatacatgggatgctacctgaaggcaggtttcaactttcaatctttttttttgttttttgggtgaggcaggagaattacttgaacccgggaggtggaggttgcagtgagctgagattgcgccactgtactctagcctgggtgacagagtgagactccaatctctag

SEQ ID NO: 47605 - DNA, 283 bp, Homo sapiens
cagattctgaagaacagtccaggtttgggagggtagagaagagagaggctttaaagatgagaagaatcatttaaatcatagggccagagacttcagttagcaggtgatctttatatttacaggacagtagaaagtccagcttgtctagaataaaaggaaggggagacatgggaaggaaagttagtaggaggggggcaggatccaaaaacgagcaattgaaaaacaaagtgaaaagttaggttttcctgtggtaagaaatagggagccattgacagtttatact

SEQ ID NO: 47606 - DNA, 3087 bp, Homo sapiens
tgcgtgcctggagcagcagcgtctccagggacaggcagccaccatgagcctcagtgaggagcaggcccggagctttctggaccagaaccccgattttgcccgccagtactttgggaagaaactgagccctgagaatgttggccgcggctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctac

SEQ ID NO: 47607 - DNA, 3732 bp, Homo sapiens
agcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtctgtgccaggctccacggctgggcaggtggtcagatcagggagcgcacctgtgtcaggcttgagttaaacccctgctgctgtggtcagaccggcgtgagggtgggagtggccacaggccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggcacagggccgtatcctgcggagacttctgatgcagcgggtgagcactgggtgtgtgagcactgggggagggcggcagagaaggcggagggccgaggctgagggcaggtgcatcggaggccctgggaaaacgcttgtggggaagacaactggaaaggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcgattaggggtcccgcccaccgagggcccgagggcgggggcgtgagaggcacaggcagccgaggcgaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47608 - DNA, 3658 bp, Homo sapiens
agcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctgtgtcaggcttgagttaaacccctgctgctgtggtcagaccggcgtgagggtgggagtggccacaggccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggcacagggccgtatcctgcggagacttctgatgcagcgggtgagcactgggtgtgtgagcactgggggagggcggcagagaaggcggagggccgaggctgagggcaggtgcatcggaggccctgggaaaacgcttgtggggaagacaactggaaaggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcgattaggggtcccgcccaccgagggcccgagggcgggggcgtgagaggcacaggcagccgaggcgaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47609 - DNA, 3223 bp, Homo sapiens
atgactgtgactgcggccagggcggctccacgacggtgactgcggccagggcggctccacgacggtgactgcggccagggcggctccacgacggtgactggggtcagggcaggagagtgtggaggccagtgaggagggtccacacccatcggtgaggcaggagtcagggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttgaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggcacagggccgtatcctgcggagacttctgatgcagcgggtgagcactgggtgtgtgagcactgggggagggcggcagagaaggcggagggccgaggctgagggcaggtgcatcggaggccctgggaaaacgcttgtggggaagacaactggaaaggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcgattaggggtcccgcccaccgagggcccgagggcgggggcgtgagaggcacaggcagccgaggcgaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47610 - DNA, 1966 bp, Homo sapiens
agcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtctgtgccaggctccacggctgggcaggtggtcagatcagggagcgcacctgtgtcaggcttgagttaaacccctgctgctgtggtcagaccggcgtgagggtgggagtggccacaggccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaaggtaggcacctcagggcgggcatgtgaattagccctaaatcaactccacgcccttgggatattaggcttcgcatagcaggctatgtagaaagtggagtccacggccaggccccgtactccagcactgtgggaggccaaggcgaggggaattgcttgagcccaggagttcgagaccagcctgggcaacatggcaagagctctcctctacaaaaactt

SEQ ID NO: 47611 - DNA, 506 bp, Homo sapiens
cgtgtgtgtgtgtgttctttcatgtgcacaccttgtgtttcttgtctcaacaacatcaccctgtccacccaactgggcaagttcttcactgttgggccacagggtacaagaggggagagtgaggctgagccaggggggcgtgtgagcagcctgggatacaggctggagcgccaggaatgacacatctcctcagagatgcctgaggtgtctgaggcttggcaggggatctggagagaagaaaggatgagaagcaagtgggggctgtggcaggccaacctccctcagcccacaatccctcccacagaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtgggagacaccgcaggcgcatagtcaggtccctgaggccgcccaggacatgggg

SEQ ID NO: 47612 - DNA, 3284 bp, Homo sapiens
tgcgtgcctggagcagcagcgtctccagggacaggcagccaccatgagcctcagtgaggagcaggcccggagctttctggaccagaaccccgattttgcccgccagtactttgggaagaaactgagccctgagaatgttggccgcggctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47613 - DNA, 3404 bp, Homo sapiens
tgcgtgcctggagcagcagcgtctccagggacaggcagccaccatgagcctcagtgaggagcaggcccggagctttctggaccagaaccccgattttgcccgccagtactttgggaagaaactgagccctgagaatgttggccgcggctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaactacttgcccattatctgtggtaaaatgatagcggaagcacactacatttgacccatcagaaaattctgccagagaggtcaaggccatgagtaaagcggccatccaacttcagtggtctgagc

SEQ ID NO: 47614 - DNA, 3977 bp, Homo sapiens
agcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtctgtgccaggctccacggctgggcaggtggtcagatcagggagcgcacctgtgtcaggcttgagttaaacccctgctgctgtggtcagaccggcgtgagggtgggagtggccacaggccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggcacagggccgtatcctgcggagacttctgatgcagcgggtgagcactgggtgtgtgagcactgggggagggcggcagagaaggcggagggccgaggctgagggcaggtgcatcggaggccctgggaaaacgcttgtggggaagacaactggaaaggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcgattaggggtcccgcccaccgagggcccgagggcgggggcgtgagaggcacaggcagccgaggcgaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagtgcgcgcgccttccgggagggggcgcctcgcggggcgggcgggtagcctgggacccccggcagatatgggggcgcacgggcggcacagcccgggggacgcagccccggattccgtccctgcccgccggccccgcgcaccccggatggggcctcgctcgggctccgcgcctccctgcagacgggcgcttggggcggggtctccacacttgctcccacctgcacctcccttgttccctgggttcaggaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47615 - DNA, 2216 bp, Homo sapiens
tggtggcgcacacctgtggtcccagctacttaggaggctgaggtgggaggatcacttgagcccaggaggtcaaggctgtattgagccatgattgcaccactgcactccagagtgggtgacagaggcagaccctgtctcaaaaaaaagaaagtggggcccatctgggggggctgcagagcgcagggtgggccaagggcaggtcccacgggcctcacctccaccacctgtgtaacagtcccagaaccccttggctaagctccacggctcctcgattttggagcggcaccacctggagtttgggaagttcctgctctcggaggaggttggtatactcaccctcggtttctgctgtgggcgctggggacgcagcgtccgcaggcacagggccgtatcctgcggagacttctgatgcagcgggtgagcactgggtgtgtgagcactgggggagggcggcagagaaggcggagggccgaggctgagggcaggtgcatcggaggccctgggaaaacgcttgtggggaagacaactggaaaggcccctcatggggtggggtggaagccgaaggggaagcggcccgggacccaccagcgggggaatgaagggcagccgagccctgagcggcccccaaggacctggacactcagtggacccctccctgcgctccccggtggtgacctctgaggccatctgcgtcccaagccgacgatggagccgctggtggagagctgggcaccctgaggagggccctgagcagcaggcgattaggggtcccgcccaccgagggcccgagggcgggggcgtgagaggcacaggcagccgaggcgaaggggcggggtccccgggcaccctgagaggtggccgcaggcgcctgacgcgctgggcataacctccgcagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 47616 - DNA, 1958 bp, Homo sapiens
agcggccgccgcgagtgtgaggaggcagggcctggtggggcctgggtctgggccttgaccaaggaggcagagaaaggtggcccaaggagggccctggggtgagtctgagcctggtggcagcgctgacccagcaaccaggggcctgtgcagcgggatgtcctgagtggggtctggccaggacctcgtggagtgcgtcagcaatgcttcactctcagacgcttggcggaggccacaggcggcctgacgtgcggaaaccacggcccgatgttctcaaagccctgctcgccgcaggtggttctggagcagccgggcggaggaagggctggtcggatgtttgcctgtcaagctcaaagcgacagattccactttccactcgtccactcctgagtgatcagggacacgaccgcagcctcgaggcctcaccgccagccagctcccgggccccacaagctcagatgaaacctggccacggagccaccaatcagggtctgtgccaggctccacggctgggcaggtggtcagatcagggagcgcacctgtgtcaggcttgagttaaacccctgctgctgtggtcagaccggcgtgagggtgggagtggccacaggccacaggtgtgcccctccctccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctggtaagaaccttgctcccggtccctcccatggaggccggccacgtgtgaggctgggaggaagagttctgcattctccgggacccgacgtggctttgcacacacggtactcagggatgttggtgctgtgtgtgtatacttgtgtatctaagcaccttagtgtacgtgtgtgtacataagcctggctttcagtctcagccagtgtgtccctgagtgtgtttgcatggccagaatgtggctttgatgtctgcactcctgagtgtatcttcgtgtcttcctgtctcctctgtgcgtttgccagatgttagttttcaccggttctttaggctttcttcactctttttcattgttttttctttttgttcctctgactgactataatctattttttactttgttgattcttctgtttgatgatgtctgctcttggacccctctagttaatattttagttcaattattgtactcttcaactccagtatttctcttttgttctttatcatttcaatctctgggttgaatttctcacttcattcatgtattattttcctgacctatagttatgtatctccgttg

SEQ ID NO: 47617 - DNA, 159 bp, Homo sapiens
ttccattcccagttttgctgcttaatagcttatatattagtcctcgggcaaatgaactatgtaggctgcagattcttactctgtaaaatggtaggagtagtacctcatatactggttattgtgaggataaataatgtacataaataacttagagcagca

SEQ ID NO: 47618 - DNA, 821 bp, Homo sapiens
aaatgtatttataaactggagaaaaatttgtagcatttaaacataaaacctcagcgttataattggtcattccttcctcttgtcaacgtgttacaacatttttgctttgctctgttacatgactcggggcttacctgcatttcacgtgagagaaaagtcaaattcatctccaccccacagcctgctatcttctgccttttaccctaaatctttggaggcgacagcttcctccccatgactgatagttatccatgctcacagctgctggcaggactgactcctttacaactgtggccttgtagttgatctgaacaggatgatcctgtctatggaagcggagtcttctctcactgcctgaaggagaaggctctgctggagatggagggctctcatctgtcaatgggtagcaccgacggtgccccagacatgctgaccatgtgtggatgtcttagaagagtggaaaggcttgagaaatgcaagcttagaatcatttctaatattacttgatgggaagtcagcaaataggaaacttgtaaaaaattggaggacaactttttgccactatcatggacaaatctatcaccactaccccaaatatcggtccctcagagaccaagtccttagattctgaggctctgctgtataattcctgttcagtagagcatctggcgaacctctagtaggacaaacagacagtaacccttgtgagaagtgagggaacttttagaactaggcctcaaggagcactgtacagtagaaacagaatgtgaaccaccacaatgaagaccacatatgcagtttgttttctagtagtcacatta

SEQ ID NO: 47619 - DNA, 362 bp, Homo sapiens
gtaggttgaaagagttaaaacagagcaaacacatttgtgtggtgtgtgctccaggctctattcacacccatctcgagaaaaatctaatataaagaataaaaatagaacagaagaagttggaaaatttccttaaaacgatgcttttgtgaactactacaaattttgaaatctgagcagagacaacaacccacaaggaaagcccctgagagaggacagacggcacggatgctcagaagcgccagacagacccaggttgtcactgcaacgatgaagctccaagagagaattagtcttcaaagtctcaaatcataaatcctagaagattccatccagattacaattcatcaataagcatatttaat

SEQ ID NO: 47620 - DNA, 306 bp, Homo sapiens
ctcagcaatgaaaaagaataaactgctgacacacaaacttggatgaatctcaaaaacattctggatgaaagaaactactcaaaaagaatgtttactgtatgattccatttttatgtttaagaacaggtaaaattaacctgtgatgacagacatcagagtcatggttactcctgaggagaggggtttactagatgggacaggaggggactctctccttctctagggtggcagaaatgctctggatcctggagtgggtgatggttgcatggggtcatacataaataaaacttgctttttacatataga

SEQ ID NO: 47621 - DNA, 333 bp, Homo sapiens
ctccccagtccaaagctcctgcctttcggccgcttctgcaggcccagctcccgcctgccagtggcctctttaggcccagcttattcctcacaacggcctttccaggccccgtttttcacttctggcagcctcttggactctaatttttttatcttttgtgtataaatcccaaaatatggaattttggaatatttccatcattatataaatattttggtaggtaatttatttggagtgagtttctgcaccaagcccgaattttttattttattttccttattatttggtgttaaacaggtttaatgacggtcatggcaactttctggcacaata

SEQ ID NO: 47622 - DNA, 296 bp, Homo sapiens
ctgccatgtatttcttttatacaacaatgaatatacaacctcagattttttgatagtgatgtttataataaaagtaacatattctttgaagaagataatgtaattttattactgtgatcaacaacataatccaaaaagactattatttagtacaggatttctcaaccttggcacactactgacatgttggttcagataatgctttgttgtaggagctgccatgtgcactgtatgatgagcagccttcctggcctttaccccatcgatgctgggagcatccttcccccagttgtgat

SEQ ID NO: 47623 - DNA, 319 bp, Homo sapiens
gccaagcactgtctgaaatactctatttcatgaagggcaggtttttgttaccaattttaacagtgaaggaacagaaaggtttaacaatttgtccatagtcacacgttctatgatgcaactgggacattaacccagggcgcacggtctccaccactatgtgagatctaataatagtcatgactaacatctactgaatgctaacaaagtgccaggcactactgtacttctccccaacccaacgctatgtttttaaatcccccatttttaagggaaggatgccaagtaaaataaggctggctggctggctggatatgcatag

SEQ ID NO: 47624 - DNA, 426 bp, Homo sapiens
atcctacagacagatggcaaaaaatagaatgtatatgtgtttggttttcatgtttatgaatttttattttacatttatgattggctcaatcagagaatcagttaataaatatacaaataaagatgaataagggccgggcatggtggctcacacctgtaatctcagcactttgggaggccaacacgggtggatcacttgatgacaggagatcgagacctacctggccaacgtggcgaaaccctatctctactaaaaatacaaaaattagccaggcatggcggcatgtgcctctaatccgaggacttgggtggctgaggcacatggattgcttgaacccgggtttcaaaaattgcttgaacctgggaggctgcagtgatccgagatcacgtcactgcagcttggcaacagagcaagattctgtgtcaa

SEQ ID NO: 47625 - DNA, 577 bp, Homo sapiens
agcccagaatgtccttaacattttctgaaattcctgcttgaggacagagctaccctcttttgagaaccactggtctcaaatatccctttgccctctttctaccctgccacactccctcacactgcgaccccagcagcctcttaatcatcctccaggactgtagctttttcagaattactttattaagccgctaatttggggttagatacccgtctccttgctcacctaccacttaacacactgttttgtagttgcaagttggtctgcatctccctatttagactacattctgtgaggcaaggaatgcccatcttggtcacctttgcatctctaatgctggcatggtttccacactcaaaagttggagcctaaaaaatggttgaatacatgaagaggaaaacagagaaataaaataaatcaataaaatggattgaaaataagcccttgactttgtgtctatagttggtaaataaaagaaaatataagaaggccctgtttatatgaagctgtatgcatttttattaactcacaacataaaccaagactgaagcctgattggatgccatgcccaaaccat

SEQ ID NO: 47626 - DNA, 415 bp, Homo sapiens
tgcagtgatggggaggggagggggtactctgggtgtagactggggtagggtgggcaaggctgagtgggtgagatatcattacagtggaaacccgaagactgagtatgtgtgagctaagcatgcaccatgaggggtctggcagttgggacggaagtgtactccccatggagagaatgtgcagaagcacgcataaccttctgaccggactgcagcaggcctgggtgacggtggtggtgaaggtggggagtgttgagaaacacaaccagcaaaggatgaaaagggcaaagcatgcattctcttccttaagggaggcttcctaaatgctgcacatgacacttttgcttatagctttttggctagaacttagtcacatggtcatatccagctgcaagagaggctggggaatatagttttt

SEQ ID NO: 47627 - DNA, 1457 bp, Homo sapiens
tgcagtgatggggaggggagggggtactctgggtgtagactggggtagggtgggcaaggctgagtgggtgagatatcattacagtggaaacccgaagactgagtatgtgtgagctaagcatgcaccatgaggggtctggcagttgggacggaagtgtactccccatggagagaatgtgcagaagcacgcataaccttctgaccggactgcagcaggcctgggtgacggtggtggtgaaggtggggagtgttgagaaacacaaccagcaaggtaggcaggggcccgtaagtgaaggactttgaaaggcctgttggagagtttctgtgttatctcaaggccagtgagataaagggcttgaagcagcagatttgtatgttagagtcctctggcctcggggtagagagtggatgaaagcaagcaggatcggattcagagaggtcaattaggagctgttgccagggacagtggcttgaaccaggaaacagcccagagaggtgcagagaggttgaggaatttgagacatctttaagaggtacaaccaacaggtttggagactgggtcggaagtaggaaatgaggaaaatggaggaaaccaacacttatgaagaaacaaagacagaggctgacaaacaaaagcaatagccattctccaggaagaaaatggtggcatgaccatgtgttttgagcaaggaaaaattgcaatgggctagagagattttgaaggactttctagaagagttagaattggagctgggtctccgacatgggtaggattttggtgggtagagaggacattccaggctaaacaatgatgcaagttagagttctaaggcagaacagtgtgtgatttgtttagcatgatttggtcatggttttcttgggagagtcccaaagaactgattctccagggggtgttactaaaactcttattgaaaggagggactacagagatgaatctcatcactctcccagaatggcacagagcttttcatggacccccgggccacctatgtaggaacctcagggggtctgtggaccactaaaagcccaacatgcctgagactccacagatactggcttccaccatgataaaggcaaaaagtccctctttcccaaaatcaatacttttattctcataggcctcctgctgtggtctagtccccatgttgaaagctgctgtcccagggtgttgcttcactacttctaggctcctgcagagtcctgcctcataggccgcactggtgagtgaggccagcaaacccatcagggagactacatgaatccaaacctaagtctgtctgacagcaaagcctgttctctccatctctccaggttcctaagccaggtgagcgttgaacctttcttgaatcaaggttccaattccaaggtaggaaagcacagtcagtcagggaaatatttacactgagaccacgcaccccagccctttcccaacctgct

SEQ ID NO: 47628 - DNA, 930 bp, Homo sapiens
ctttgaggatatttagccactcataaataattgtctcaaggtatttaaaagtgatttgtgccttattttaatgcaaaattagcagttttattctattttaaaaacaaaggcagaaaaacaattctgcatgttattctttaaaaacatccagaataatactaccaagtatttgtatttcaaaccagtaaaattttgaatattcaaagtctgctcttaaacttagacttcctagtattatggtggttatagtgagaatgaaattaaactgggtgagttccgaaataaaggaaagtgttatattctacagtgcccatattttctatggtaactaaatcaaatatttgtaagttcctctgctttttgaaattatttttcaaagaagcaacacctgttatacaacagaattgtataaactaaaaagacttttggccttggtacatagtctttatctggcctgcaatggagtcatggttctttctgaatcccactctcacttttttctttttacccttagatattgcatccgtggtatttcaggggtatagagaaataatattggaatttaggagctatttttttaagtgaaaatattactaagtggtatcttttgatgattacctactttaatgtgtcttagaaaagcaccaaaacatagcatgattattttttcagttaattaaaattagttaataacatgttcatttaaaaactattcattgactttttgtaccagtcatatgcagggtacagtaactgaggatatgggaaataaaataactgacatagtccctgctctgaaggaacaaaggaaaaggaattgcaaatttttattaaaataataataataataataataataataatgtgttttgcctggaagttattagctgagattctaacacacaaaaagttcaaaaaaaaagaacaaaa

SEQ ID NO: 47629 - DNA, 245 bp, Homo sapiens
tgccaagtaatattttatgaatgttgcatatttatctatcaagtgatggacatttgggctctttctactttttagctattaagaataatgctgtgaacatgtgtgcacaagtttttatatagaaatatattttaatttttttcaagtgtatatctagagtggaattaccagatcatatggtaagtatgcaattaatattttgaggaactgccaaactgctttccaaagtgggtgcataattttac

SEQ ID NO: 47630 - DNA, 528 bp, Homo sapiens
agagggaagccctgcctccctgggtctttgcctgtagcagtgagcctagaaatgcatgaagccgcaggacctctcacaaaagatgtgggcaattaaagcagctagagccgggcacggtggctcacgcctatcatcccagcactttgggaggccgaggcgggcagatcacgaggtcaggagattgagaccatcctggctaacacagtgaaaccccatccctactaaaaatacaaaaaattagccaggcatggtgctgggcgcctatagtcccagctacttgggaggctgaggcaggagaatgacatgaacctggggagtggagcttgcagtgagctgagatcgcaccactgcactccagcctggacaacagagtgaggccctgtctcaaaaaaagaaaaagaaaaagcagccagaggcccggcatggtggctcccgcctgcaatcccagcactttgggagggcgaggtgggatgatcgcttgatcccaggacttcaagaccagtctgggcaatgtagtgaaaccccatc

SEQ ID NO: 47631 - DNA, 4270 bp, Homo sapiens
  misc_feature (41)..(41): n is a, c, g, or t
  misc_feature (595)..(595): n is a, c, g, or t
  misc_feature (718)..(718): n is a, c, g, or t
  misc_feature (2456)..(2456): n is a, c, g, or t
  misc_feature (2480)..(2480): n is a, c, g, or t
gatcaatactgaggccgcgtccgacccccttgagccgaganccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggnaacaagaccgtgacctacttgggaaagttcgccttcgactccccttccaactggtgccaggacaacatcattagcctcatgagcgccggcatcttgggggtgcccccggcttcaggggcgctnagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgcccnctgccctcccactccttccccttntcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatca

SEQ ID NO: 47632 - DNA, 470 bp, Homo sapiens
  misc_feature (49)..(49): n is a, c, g, or t
gcacgagagaaaagcactctaacttatgttgctttttttttttaaacangcagacatataaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatca

SEQ ID NO: 47633 - DNA, 1087 bp, Homo sapiens
ctgcactgccctcctgcacctcttccatgcagctgtgcagaggaaattacctgatgttccaaaccccctcctgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatca

SEQ ID NO: 47634 - DNA, 360 bp, Homo sapiens
  misc_feature (24)..(24): n is a, c, g, or t
aattcgcggccgcgtacgacaganaacagaaggggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatca

SEQ ID NO: 47635 - DNA, 4342 bp, Homo sapiens
  misc_feature (41)..(41): n is a, c, g, or t
  misc_feature (595)..(595): n is a, c, g, or t
  misc_feature (718)..(718): n is a, c, g, or t
  misc_feature (2456)..(2456): n is a, c, g, or t
  misc_feature (2480)..(2480): n is a, c, g, or t
gatcaatactgaggccgcgtccgacccccttgagccgaganccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggnaacaagaccgtgacctacttgggaaagttcgccttcgactccccttccaactggtgccaggacaacatcattagcctcatgagcgccggcatcttgggggtgcccccggcttcaggggcgctnagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgcccnctgccctcccactccttccccttntcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgttttttgt

SEQ ID NO: 47636 - DNA, 420 bp, Homo sapiens
ccagtggccatgcatctaccctcaacacactaacctctttacagcattgcagtggttgacagtttcctcctcctccctcactctccccactagaaatctgtgagactcccatacttaacttgttttcctcctccttctgtggaagctcctcttgggctttttcccaggctccctctcccctaaattttgatcattctcagagactcatccttaaatcatttcctttgtctccctgttcattctcctcaagtcacttatcttctctcaaaggccctgtgttttgtgacttgtaaatttctatatgcagcccagccctcagtcctctagtccctctccactgaaagtcccacaggcactcattcgcatgccccagaatgagccatcagcatcctgcttatttcctcttctctctctccactc

SEQ ID NO: 47637 - DNA, 455 bp, Homo sapiens
taacctaaacaacaagaatttatttctcacactccaggaagctgaaagtccaagatcaagctgccagtggattctgttcctggatgagggctctctccctggcttgcagacagctcactgtgccctcgcatggtgaagagagagaacaagcaggctctctggtgtcccttcttataaggacactaatcccaacatgagggccccacccttatgacctcatctaaccccaatcacctcctgaaggccccacctcctaataccatcacactggggcttagcacctcaacatatcaattttggggaaatacaattcagttcacagtgcatagatagatattaattgatattatcaaaagaaaccatgggcagataaacccaaaaccaaactgttttaatggttatctattgggaagaaaaagaaacagggtgaacgggaagttacagaagcaagattt

SEQ ID NO: 47638 - DNA, 883 bp, Homo sapiens
ctatttgtgctaaaagctgaaatttcattattttaaagctaattgcctgaaaatatattggcagaattttcccaaattgtaataactgtgatacatgcatataaaaaaatccttaatgtcaacacacttaaactacatgctaaatagtcaagaaaaaaatggaaacagtagcatccatactggaatcttgccatatttttttcattttagaatagattttggcagtctcatcttagaatcctatccttaggatacatctgaaagcattcctttggcatggaccccagagatagttttggagccaggcattgatgtagaggttcaccaaacatatttagggataatagataaattcataatgcttttttgggtacactgaaatgtttacatactgaattctgtaatatgaactaggaacgcatttactatgagaaaatatggctcttaagcagtgtaagagtgaaaatataagcatatttccattaacagtatattgtactgatcagcagctcttttctcaaaaattttaacatcagttaggcataattattttccataaggtttttttccaaagggcccttatatatttgatatatcccttttgggggcttttaaaaaaaggcaaaattttttttttttcccccccaaacaacaggggggggacaaaacacacgccgcagctaaaacacaggaccacgcgggggggcccttctttttctaccagacggcgaccatagccccccacctacaccacacaaccaccggcggggggcaggcggaggagggcgccaaccaccacaaacaaacaagaccaaatcggaaagaggacacccgcacacacagcaccaccagcagcaagcaacaccacacgaccaagccagtg

SEQ ID NO: 47639 - DNA, 1609 bp, Homo sapiens
ctatttgtgctaaaagctgaaatttcattattttaaagctaattgcctgaaaatatattggcagaattttcccaaattgtaataactgtgatacatgcatataaaaaaatccttaatgtcaacacacttaaactacatgctaaatagtcaagaaaaaaatggaaacagtagcatccatactggaatcttgccatatttttttcattttagaatagattttggcagtctcatcttagaatcctatccttaggatacatctgaaagcattcctttggcatggaccccagagatagttttggagccaggcattgatgtagaggttcaccaaacatatttagggataatagataaattcataatgcttttttgggtacactgaaatgtttacatactgaattctgtaatatgaactaggaacgcatttactatgagaaaatatggctcttaagcagtgtaagagtgaaaatataagcatatttccattaacagtatattgtactgatcagcagctctcattttaacatcagttaggcataatatttcatagttttcaagccttttttttctgctaacattcagacaagtaacaggcaacaaagatttaagaaaaatttatggtggaaaaccttaaaaattgagacaattcaatctatttaatctattaaattttttctctgaattgggtatatggcatcattatttgattttagcagggaacatttggatttagcttatgaaacacagatgttctatgggaacatggcttgaagccaatatgtaatttaatgtttttccattaaacaaacatctgaacaccaacttagctaccaagtgaggtcaagtgcctgaaaagtactgtatacatctaataagcatgttttccttatgtaaaagatgcactttatggcaatgcataccaggctttcacctgctagaaacatacttgttgccaactttgccatctaccactattctcctccttagaacaggtagaaacctattttacaaaaaaaaaaaaaaaaaaagatagacttaagtttatcttagttcaagattgcactttttaaaaaactctggactattttcagcaatgaccgaacagcttgtcacacatcatagttgtgatcttttttgaggagttatttattggggttaatatctactataaataagcattcttgtgcttgttacaaagcataatgcaaattactagttctatactagtataatgaaaatgactagttctatactgttatgtacttttgtcttcctccccaaaaaggaaacagtttagcattgtctaaattcagtggcacttttttagtaatacatttttttttcttagatacaggagaactattgcttttacctgcagaaactcaaatgttttcgctaaaactttaaaattctaaaatacgtagtatgggtattactaattgtacattttacatttcaaaaatagttaaaattcaaatgttaagtctttgacttaaaaaacctttaaatatagataataccttaacaattataactttgtgatattattaaaatatatttgtctgttaacttcatcagttgtattaaataaaaatagttaacagcttgcact

SEQ ID NO: 47640 - DNA, 456 bp, Homo sapiens
actggggcaactggatggcattcatgagaactgagaaaaggagttgaagcaggtttggacaagaaaattaagagtttgtttttgacatgtgaagtttgaggtattagtaagacatccaagtggagatgtccagtaggaatttagaattgggagtcactggcatgcaggtgcagcagaggccagacacagggatgatgaacatgccagatctttctctaaatggagcacagtgcacgtggtgtcattaatagttcttcatttatgtgtcttatgtgtaggcatgactaaggggtagggttgactattcttgagctacctcaccaactgcctattttattccaactcttgttcccatccttgctctccttaagaatctaagaaaaagatgcccactcttgctttcctttgaggcagctgctgtctttttacacagctctcgtctaagcaatgggacaa

SEQ ID NO: 47641 - DNA, 358 bp, Homo sapiens
ttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtgtaccaaggctaatcagttttataattttgcataattttctaactgcgattatcatttagtttagaacaatttatttctcaaggcccatgtaaatattatttttaaaatatacagtcttaagaattcatgggcatattttatggaaaggaggaa

SEQ ID NO: 47642 - DNA, 409 bp, Homo sapiens
ttagcagaaaccagctcatctaaataataataacacccaaaacttgaatagaactccctatgatccaggaactgttttaagtgcttaacactaactcactgaaacatccattacccctgtattctattgaggaaactgtggtaccaagagaggctaagcagcttgctcgaacgcccatacccagtaagaagccaagcttggagatgaaccaattcataggagtgtgtgctctttaccaccatgttatacttcttatctacatggaacactgtaggctttaaaaagtctagaatttttactcaggaggctgagacaggagaattgtttgaacccgggaggtggaggttgtggtgagccgggattgcatcattgcactctagcctgggcaacaagagctaaactccatgtc

SEQ ID NO: 47643 - DNA, 734 bp, Homo sapiens
ctgtttcacgcttttgtctttattatccctcgtaactgcccgccctgcaaccaacccgctcaaacaagcaccctgactggcgcattcttactcattctagcctgggtttcaacttcaaggagcttcagcgcccctcactcccttgccctgaaagctggctaaactacgcaccttttctccccttttgaaatgacctttccagatatttctatggaattcagtgccattttctgccgctgttctcaccacattcattcatcatgtttagttttaaaagtaccagattctgtcgatttctccaactgaactctgaaatctttgaggtcagggagcttgcctcattctattttgtattcccagtacgtgacacatggctggacacaccagaaattgtccgatcaagtttgtgggtattaagagtggtcaaagacgctggggagggcagtgctgggagaagggcagcgcgcgtcttggcgaccccagcgcagttcgaactactccggagtctggtgtggagccgagagggaggcccgcacttttctccccgcggagctgcgctgagtctgaaataggtgtacgcgtcagcggggcaggaaacggaaagacagtgcagtaattggtggaaagctggaagtgggcacctcgagggcctcagccccacgaacacagtcacccaggaaaagcgaaccgcgccaggccctgtcatcgaccgctgggtccgtcctcccagcgct

SEQ ID NO: 47644 - DNA, 401 bp, Homo sapiens
acaatctctaaaatattgttttgtgaaatcggtaagatgcagaacagtaaagaaagctgccatagattatcatcagaaaaacacaagaaactaacagttgtctggaagaaggaaaactagaggctgggaaaaaaaggtggaagggagatttaatttttatggttattttcttttatgctatttgaaattttatcatgtccacttattatatatacagtatgtatatgtacatatatatacacacagtaaggaaaacacataaaagggctgtaattagggcgggtgcggtggctcatgcctgtaatcccaacactttgggaagccgaggtgggcggatcacgaggtcaggagtttgagaccagcgtggacaacatagtgaaaccccatctctactaaaaata

SEQ ID NO: 47645 - DNA, 391 bp, Homo sapiens
attggggtaaagagagattggtttgcttaagcaggaatgcttatagtcagggcttttttatttccaggcttccattgcctctcacacttcgtagcctgtcaaagtcaagttagtgcattaacctcagtgacatagaactgagaaacaaggtcacctatctgaatcttacctacttgtgtgtggtttgtcctccattcattgtaatgctatggtaaagtactccttgaaatatttgcaatcagagacagatcggatgtgttatgactaggttccaactattatagatcatcaccattttccaagtataaaatcagaaggttacacatattaagaaatgctgaaggaacaaagtatgtttggcttcctgcacgataaacatttgtgaattttt

SEQ ID NO: 47646 - DNA, 788 bp, Homo sapiens
cagcctcatttgaagtgcacaacagtcatatgttgctagaggctgctgtactgcacagcataaacacagaagaagatatagaacattcctaccctcacagaaagttgtcatggataagactgctctagaagttgtctgccagtatcagccaccatgccttgcctggattactgcaagagaccagtctccctgatcccagtgtcttcctcctcatgcaaagtggtgtgtgtttctcaagggtaaccttgctccctgtcactcacatacacagcttcttggcctgacacacaagacactgtgtgatctgccctctgcccctccacttgccttattccctgccgtgagtcctcagagacactaacccagctgcatgaaaactcccccagacccttgaccttgggagtcagtcaaccttttgaggttctttgaagctttcatgaaaacctaactttgtgaacatggaaatgataatgctcggccaggcgcggcggctcatgcctgtaatcccagcactttgagaggccaacgcatgtggatcgcttgagcccaggaattcgagaacagcctgggcaacatggtgaaaccttgtctccacaaaaaatacaaaaattagctgggcatgggggcacacacctgcggttccagctactcgagaagctaaggtgggaggatggattgagcccaagaggtggaggctgcagtgagccgtgtactccagcagtgctgtactcgtgtacagtgtactccagcctgggcaacagaaatgagaccctgtctcaaaaaaaaaa

SEQ ID NO: 47647 - DNA, 411 bp, Homo sapiens
ttccacagcaccctgggcttgctgccagtagacccttatctcactgcaattgttctttgcttttctctaccgcctacctatgtgctccttaagggaaaggggagtctttattatcttttatctatagtctctacagtgcctggcacagggctcaaaaagtgtttactgaagggatggatggaaaaatactattgatattttcctatttgttattcagcctgcccatatttaaggtaaactgacattcataaaaatgcacctaaaatgagttatgcaattcaaaactgttacatatattgatggttcagtttaaaattcacgtctctaatgtttttgcactttggctttctcttctaacagaattatatatactatatatcatcctagcactttgggaggccaaggcaggcg

SEQ ID NO: 47648 - DNA, 432 bp, Homo sapiens
tggcttttttttttttgttgttggagacggagttttgctcttgttgcccaggctggagtgcagtggcgcgatctcggctcaccgcaacctccgcctacctatgtgctccttaagggaaaggggagtctttattatcttttatctatagtctctacagtgcctggcacagggctcaaaaagtgtttactgaagggatggatggaaaaatactattgatattttcctatttgttattcagcctgcccatatttaaggtaaactgacattcataaaaatgcacctaaaatgagttatgcaattcaaaactgttacatatattgatggttcagtttaaaattcacgtctctaatgtttttgcactttggctttctcttctaacagaattatatatactatatatcatcctagcactttgggaggccaaggcaggcg

SEQ ID NO: 47649 - DNA, 2289 bp, Homo sapiens
tgctctgtcccctgcaacaaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaaggggtgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgattttttttttttttttttttttgaaaagttaaaaattccttaattttttattcctggtaccactaccacaatttacagggcaatatacctgatgtaatgaaaagaaaaagaaaaagacaaagctacaacagataaaagacctcaggaatgtacatctaattgacactacattgcattaatcaatagctgcactttttgcaaactgtggctatgacagtcctgaacaagaagggtttcctgtttaagctgcagtaacttttctgactatggatcatcgttcctt

SEQ ID NO: 47650 - DNA, 419 bp, Homo sapiens
gtgggttcctgatctgtagctcttccccagaacttgacccctcaaggaaaggaaaagtttcctcgccagacttacctctgactccttccccaaaaaccatccaacccctgcttcccacaggctataatctccttacccaggtgtcccgacaacccccacatccctctggggtcactctggtagctcagacctgaccaataggcagctggaaagctggtaaatttcacttcttttgagattggctgccgtcatctcctccggctcctctctctgcaggccccacaaacccacaggctgtggtgtgagcccatccacttcctgggcctgtacacagcgactgggaggtgggagtctctcctttctctggccccaggatctagcccctcccttcccctctcctccagatgcctcatttgagt

SEQ ID NO: 47651 - DNA, 482 bp, Homo sapiens
aagcaaaaacagacagctgaaaagtcctctatctcctacaagggccctaactggcaccccagatgacacagagcctgcctgcttatgctgtagtctgcctactctgctgtctcttcacatggtctcctcagaactgaactattgtatccatctcacactttatgcctcttctttcttaggcaccccgtccctccatccttccagaaccatctttgaggtctcatggctaataaaaacctaggctttacctgttccctctgtaatccctccaaaagatgagacagatctatgcttggtcatccagtaaactgaccagctgtgggcacgcaagtgtgggaggcagaggcatgctcagagctggctgccaggacctctgacttgccttcctttcacccacccccagtgctccacccaggagtcctgcctggaagctggaatgggcaagggctgctggagtgggacagggagaagaggaaggcctg

SEQ ID NO: 47652 - DNA, 3366 bp, Homo sapiens
tgctctgtcccctgcaacaaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaaggggtgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgatataactgcttcaacactagggggtcctaaaggctttctatcttgctagtccctggggcctcaacatctcatactggttcccttaactctgcctatacctctgtaaataattccttcactaagttctcttgatgaagcaaaaacagacagctgaaaagtcctctatctcctacaagggccctaactggcaccccagatgacacagagcctgcctgcttatgctgtagtctgcctactctgctgtctcttcacatggtctcctcagaactgaactattgtatccatctcacactttatgcctcttctttcttaggcaccccgtccctccatccttccagaaccatctttgaggtctcatggctaataaaaacctaggctttacctgttccctctgtaatccctccacgcaagtgtgggaggcagaggcatgctcagagctggctgccaggacctctgacttgccttcctttcacccacccccagtgctccacccaggagtcctgcctggaagctggaatgggcaagggctgctggagtgggacagggagaagaggaaggcctggatgaggagagggtggcatttgctctgagactgggtcctttttagacctttgcccgtcctcccccacatctcctccctttggctggacagtcctgaaccatgaggtcgataatgtctgcagcccaaggccgagtttgcgcaaaacccatgtgttctttggtaaacgtgatgtctgtgtttgctcagtttatgaccccctcctatgagggtaagaggtccctgaaataggaaccctagaggagaaagtctgaaaaggactgcctgggggactgtaaatctgagcttgagggcttcctgagcaacccatggaagttatcccacctttgacttgaggagaccttcatctaaggagaatctaaggaggccttctggtgtctcccccacacatccccgacccccagatctaacctccttcccaattacagcttagtctccagggctaggactggggtaaagcaaagtgagtcattcacctggggggactaaattttaagggggtggtgaacaatttattaatcaagataggactttaatgcaatattattttaaagtcaaaattaatgcaaaaaatccatgatgaacaaaatagcctacttttaaataaaaacaggatcagcattattccctttcttttttggctctgtcttttgtaataaggggagagagtgggtctgtcttcttctaaacattttcttctagagcttcctagctcctacctctggaccccttcaggcttttctcatttgagcaagataaccactcccacttcttctacttccttacccacccccaagcctg

SEQ ID NO: 47653 - DNA, 599 bp, Homo sapiens
gcccattcctgggagtattcagtggaagctagttcttgtgtcactttcttctctgaatgttactgaagattccctgcccttctctggctcctttcaatgctaagattgtatatctataggtgaagacatggaggcagaaataaatgtgtttagttatcgctaagggaaataaacatgatgcaaaacagtgtgctctcaattttgttggaagaatatagttaaattcattgaaaagagatggcaaagaagtgaatattaatgcttggactgtgggagatgttttcacctttggattgttttgatttttccaacttttctacagttgacttattttaaaacccagtaatgtatctgctacatgtgtgaagtactttctctactgaaacaatagattagggcaggggcaggagggagtttttttgtaggtatgtacatagggtgggatggattgcagagggccttgaaagtcaggcaggactgtttagatttgaaggtcactatagtggcaatgaaaatgactttatttgctaaaccaaactcaggactgataatctaacaaacaatagcatgttaatggggataagaggacagaatacagt

SEQ ID NO: 47654 - DNA, 627 bp, Homo sapiens
attttcaccttcaacctatccttcctgaagcccaaacttttaaagaatttacttccagacctggccttcagcctaatatgattagggtgtttttctgagtgtctgtcaaattatgctggctaatttcaatgagaaaagattttagagtcacagtgaacccatccataaaaggactaaaagctctctctggtccctgagatccacaacccctgagagaagccagaactacaaatgcatcgtctagactttgaagaagcagggtatgattcttaatatagctcacccatcgctaagtcaagcctagactctaatatttttctataacaggagaagcctccctgactggagactagagtctcacatcttctgccaccacatgaatagactaaaaagaaaggagagtcccacatcaggccaagtggtgacctgtggctatttcagctcagaatgtcagcctctgaagcatcaggtttgaatgactttggtgtcatgggattctgtccattgtccgtttgagtctgctgacatgcttcctctggaaagtgcagtttggcatggatgagtcagtggttttttattttggggtgttttttaaaaaataaaaatgaattgctttgagaaatttta

SEQ ID NO: 47655 - DNA, 2176 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaa

SEQ ID NO: 47656 - DNA, 2270 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaa

SEQ ID NO: 47657 - DNA, 1040 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgctgagagatgttacatgtcttgctcaaggtaacccagttggaggacagtcttggcttcagctcatttgtctctagatcctgtcatcttaccactgtgccttgctgcctctgaaaaggcagaaggaagttattctctttctagctttgtggagaaaagcaggtgatacctcaacaccaagccatagggagcttccagtgactctgcaaagaaaaaaaagaccaactcagactccagagcagccccaccagagcctgagcagttggagccttccaccttcccacccctgcgttcctcttgtccttgggcatctcctgtgtgtgcttcggggaggtgatagcagtgctatagaagtagtggagtgaagatgttttcctatccccgtggccttagatagtgtctttgtctttgaagagtcaggggcatctggggagctgtctaaccgtatctatcctgtagactcgggaggaagctgctggctgctgtagacagaagagaatccctgtgcttcgggctcctaggaaggtgtctgccatcctctctgtgccactgttatctgtcttcttccccatcagataacaccatcca

SEQ ID NO: 47658 - DNA, 2325 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggtaacggcgccacggggtaacgggctggaggcgccacagggagcggctggcgctgtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaa

SEQ ID NO: 47659 - DNA, 2711 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggtaacggcgccacggggtaacgggctggaggcgccacagggagcggctggcgctggcaagcgaagcttgggggtggggaggtagagtgagccctcagtaggagggacgagggcaggggtctgactgcctccccgggaccgcccccacctcctctctatcagggccccctccccccatccctgtctcaccgggcgcgggggacggggctagagcggagttagagcaagaagaatttccacccctggattccctctgaaaccctagatcggggtatatgttaagggattacgaaaatctaggactttttgtggggctttttattaaagggggggagcccgggagcaataccttggaaagaagccctgttgcttagagcggataaccaacggctgaactcttggggtttgctgtgaggggtgcggtctagcttcgaatgtacagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcaaaaaaaaaa

SEQ ID NO: 47660 - DNA, 2310 bp, Homo sapiens
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgagagaagccagaactacaaatgcatcgtctagactttgaagaagcagggtatgattcttaatatagctcacccatcgctaagtcaagcctagactctaatatttttctataacaggagaagcctccctgactggagactagagtctcacatcttctgccaccacatgaatagactaaaaagaaaggagagtcccacatcaggccaagtggtgacctgtggctatttcagctcagaatgtcagcctctgaagcatcaggtttgaatgactttggtgtcatgggattctgtccattgtccgtttgagtctgctgacatgcttcctctggaaagtgcagtttggcatggatgagtcagtggttttttattttggggtgttttttaaaaaataaaaatgaattgctttgagaaatttta

SEQ ID NO: 47661 - DNA, 521 bp, Homo sapiens
tcgggtgggaaagaagttgagctgtgaattctcctttcttcatgaaacttacaaattgttttcatatagcattttccatgaaagtttggaatatttatgccaagaatgagcaagttgctaaaacagtctcccttttcatgtcataaaaaagttgacatcgtctaaccagtccttcatttgtcagtgccattatagcaagggtccatgtgggtgacaaaaagtggatggtgtgcccaggaaactgggcaagatggtcacaaggctcttctgagctggtgctaaggggttcctcaagtcaacacacaaatttcaatttcaaggaccataactgtcctatatatttttttcttactctgtctattattcaaagccatccctgatacagtttttgttggggatgaggtgaactgtgtgacagtggggaaagggatggaattgaaacagcatcagtgcaagctttgggacagtctttaaaaaatgataatacaccatccaaatgatttaccaataggtcttctaaa

SEQ ID NO: 47662 - DNA, 1166 bp, Homo sapiens
  misc_feature (980)..(980): n is a, c, g, or t
  misc_feature (986)..(986): n is a, c, g, or t
  misc_feature (991)..(991): n is a, c, g, or t
  misc_feature (997)..(997): n is a, c, g, or t
  misc_feature (1010)..(1010): n is a, c, g, or t
tccaaattgtttatttatatatacaaagaattatcagggttttccatggagtaaatgccccggataatcctctgaaggaagagcatttagtccaacttaatgaaaccgatatccttcgcgtactggacggaaacactggcggcacatatggaggccatattcccggatcagaccgtgccggtttgaacagacacgacaagagcgagaacccgggccgaatttacgcgggtggctccagtacagctgctggtgacccatctttgctctcagccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtggaatntggccncggtngtgccngagcctcaggggnggacagtcttgctgtggccgccccagtccggggactgtttgtccggccccatggtgcgtggccccgtgtgttcgggcatccggctgcccgggcgtgtcgcacatggcggggcgtactgggcccatctcttcgcgctaacagtctctctgtcctctt

SEQ ID NO: 47663 - DNA, 1599 bp, Homo sapiens
  misc_feature (14)..(14): n is a, c, g, or t
tttgttttttatanaaagtttgttaaaaagaggtggtccggtccggattcccgggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47664 - DNA, 1822 bp, Homo sapiens
tccaaattgtttatttatatatacaaagaattatcagggttttccatggagtaaatgccccggataatcctctgaaggaagagcatttagtccaacttaatgaaaccgatatccttcgcgtactggacggaaacactggcggcacatatggaggccatattcccggatcagaccgtgccggtttgaacagacacgacaagagcgagaacccgggccgaatttacgcgggtggctccagtacagctgctggtgacccatctttgctctcagccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47665 - DNA, 2209 bp, Homo sapiens
aatttgagacggagtctcactctgtcgcccaggctggagtgctgtggtgcaatgtcggctcactgcaacctccgcctcccgggttcaagcgattctcctgcctcagcctcccgaatagctgggattacaggcccccggcaccacggcccggctaattttttgtatttttagtagagacggggtttcatcatgttggaccaggctggtctctaactcctgacctcaggtaatccgcccgcttcggcctcccaaagtgctaagattacagacctgagccacttcgcctggcagggaccgtatttcaagtcctgccctcccaccagcgcctgcgccccgcagcagtgtccggctccctgccgacgccctggagctgggacggcctggggcgctggtcggccgccttcccccagaaggaggcgtgagcggggcgtggccggaacgtctctcttcggagccgcgccccgggcgggcacagttacgcgccgcacggatcatggccgcagccgctctggggcaggtgggttcgcagccccgcgccggggtctgggaaataaccgggggaggcgcacttccgggaagaccactggcctgcagccggtccgactcggcgccgctcctcccgccctggggttccgctgcagggcgcggaggaggatggcgccctttggaaaggagcacgaggctttaatgggatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47666 - DNA, 2846 bp, Homo sapiens
gggcatcagcctgtgcgggagctggaataaaggggcccagacctccagggccgggtgcaggtgaaggcagagttggacctcaagtctcagctctgggaattggactcaaggtcctattttcttggaatgaaagttgaaaaaaataagagatggggattgctgtgcttcccaaactcctatctgaagctttgcacctggattggaaatcgaggcagcgtctcatggtcaaagtgacagatgctgcaggctggctgagacgatcccttctgactgtgcgatgtcaaacagcagcagcgtttcccagactagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcaggtaatcagagcccagttgatcgaataccttcagagaataagcacctgtactcctgggtctggcggaggaggggctggggaactggactcctgggtctgagggaggaggggtggggcccgtactcctggatgtaagggaggagggtctgaggcctggactccagggtctgagggaggaggggctgggggcccagacttcgggtctgagggaggaggcagctagagtctggactcttacttaggtctgaaggaggcgggcctggggtctgcacccctgagctctgggggagcaggacctgtcggtccttggtcttctaaggcctgtcagcacttgggtacccggaggccttcacttacctgtgtgccttccctggttgttttcttgtctgagctgatttccaggctgcgaccaaaggtctctggggtgggaggcgcttgcgtttgactttgccgcagcatggaggagggggcgggagctgactcagctctttccagcgagccctcgtcagggcagggaggggacttggcctccttcaggaccacctgccccgtctagaatggactgaaactgggacagaacaggcaggccagtgggacctccaagtgcaggaggtggcgagcgagctgccagggcccctgctgtgccccactcaccccctctctcacttctttctccacccaatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47667 - DNA, 1600 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (14)..(14): n is a, c, g, or t
nnccnttntttgantcctctacactgttggcctactgacagttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47668 - DNA, 2034 bp, Homo sapiens
aatttgagacggagtctcactctgtcgcccaggctggagtgctgtggtgcaatgtcggctcactgcaacctccgcctcccgggttcaagcgattctcctgcctcagcctcccgaatagctgggattacaggcccccggcaccacggcccggctaattttttgtatttttagtagagacggggtttcatcatgttggaccaggctggtctctaactcctgacctcaggtaatccgcccgcttcggcctcccaaagtgctaagattacagacctgagccacttcgcctggcagggaccgtatttcaagtcctgccctcccaccagcgcctgcgccccgcagcagtgtccggctccctgccgacgccctggagctgggacggcctggggcgctggtcggccgccttcccccagaaggaggcgtgagcggggcgtggccggaacgtctctcttcggagccgcgccccgggcgggcacagttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47669 - DNA, 1933 bp, Homo sapiens
aatttgagacggagtctcactctgtcgcccaggctggagtgctgtggtgcaatgtcggctcactgcaacctccgcctcccgggttcaagcgattctcctgcctcagcctcccgaatagctgggattacaggcccccggcaccacggcccggctaattttttgtatttttagtagagacggggtttcatcatgttggaccaggctggtctctaactcctgacctcaggtaatccgcccgcttcggcctcccaaagtgctaagattacagacctgagccacttcgcctggcagggaccgtatttcaagtcctgccctcccaccagcgcctgcgccccgcagcagtgtccggctccctgccgacgccctggagctgggacggcctggggcgctggtcggccgccttcccccagaaggaggcgtgagcggggcgtggccggaacgtctctcttcggagccgcgccccgggcgggcacagttacgcgccgcacggatcatggccgcagccgctctggggcaggtgggttcgcagccccgcgccggggtctgggaaataaccgggggaggcgcacttccgggaagaccactggcctgcagccggtccgactcggcgccgctcctcccgccctggggttccgctgcagggcgcggaggaggatggcgccctttggaaaggagcacgaggctttaatgggctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47670 - DNA, 1389 bp, Homo sapiens
  misc_feature (14)..(14): n is a, c, g, or t
tttgttttttatanaaagtttgttaaaaagaggtggtccggtccggattcccgggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccagagacccagacgccgccgctggccttttatttcgtattgcacttcagtcgaccggctgcaaatttagtagtagtaggcgccgc

SEQ ID NO: 47671 - DNA, 3055 bp, Homo sapiens
tccacaaacagagtgctacctccacaaacaggttcaaatgattctcccaggctcaagctatcctcctgcctcggcctcccacagtgctgggattacaggcgcgagccactgcgtgtggcctctttctatgattagatctattttggcatctcttgtttcttggcgtcaatttctgtttttgtttttttttttttctgtttgtgcgcccctttctgtgtttctttttctcatccttcctcttccatctcttactctctttttttcatcttggctctgagggcagctctcctgcccacaggctggctgtcgcactgtgtttgtctctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcaggtaatcagagcccagttgatcgaataccttcagagaataagcacctgtactcctgggtctggcggaggaggggctggggaactggactcctgggtctgagggaggaggggtggggcccgtactcctggatgtaagggaggagggtctgaggcctggactccagggtctgagggaggaggggctgggggcccagacttcgggtctgagggaggaggcagctagagtctggactcttacttaggtctgaaggaggcgggcctggggtctgcacccctgagctctgggggagcaggacctgtcggtccttggtcttctaaggcctgtcagcacttgggtacccggaggccttcacttacctgtgtgccttccctggttgttttcttgtctgagctgatttccaggctgcgaccaaaggtctctggggtgggaggcgcttgcgtttgactttgccgcagcatggaggagggggcgggagctgactcagctctttccagcgagccctcgtcagggcagggaggggacttggcctccttcaggaccacctgccccgtctagaatggactgaaactgggacagaacaggcaggccagtgggacctccaagtgcaggaggtggcgagcgagctgccagggcccctgctgtgccccactcaccccctctctcacttctttctccacccaatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggtaagtagcacccccatccccagaacgactggcgcactgggcgttggagacacagggaccagcgtgcgtgctttcggccatgcctctggatgtcacatgaaggtgacatcatcagcaccgtgcagggctcagtgctaagtgacctccctggtccctgaaaacaaaccatggaaggaaggaggaggggattatttttcagatggacaaaaaggctcacagatgggaaggcattgggtggaggtcagtggggaaaccaggactggtccctggaagcctccaggagtgaagcttacactcagctcattggcttctcgccccagaagcctcccctgatcccccaggctgggctgcgctccccatacccagctcccacagtcgtttgagcctccaaagcccctcacccccgtgtggactttctgtgtaaatctgtctcccagtggcctcagctcagcagggcaggaaggagacagctgggtctcctgggcaaccaaggcagagggtgggcactggcgtgttgggacaggaatgtggccccagctgggggtgcattcaggtcctttcagccacatcctgtgaggtctcctgagggccaggccctgtgctggcagaagctggggacacagatgagtcagccccgagccctgctctcctgggtctcccaggctggtgggagccccagtattcggagctgcatgttctctggtgaggtgacccagggcattgtgaaagccttcacagaggccagaggcggtggctcacgcctgtaatcccagcactttgggaggctgaggcgggcagatcacgaggtcaggagatcgagaccatcctgattaacacagtgaaaccccatctctactaaaaatac

SEQ ID NO: 47672 - DNA, 1242 bp, Homo sapiens
tccacaaacagagtgctacctccacaaacaggttcaaatgattctcccaggctcaagctatcctcctgcctcggcctcccacagtgctgggattacaggcgcgagccactgcgtgtggcctctttctatgattagatctattttggcatctcttgtttcttggcgtcaatttctgtttttgtttttttttttttctgtttgtgcgcccctttctgtgtttctttttctcatccttcctcttccatctcttactctctttttttcatcttggctctgagggcagctctcctgcccacaggctggctgtcgcactgtgtttgtctctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47673 - DNA, 539 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (14)..(14): n is a, c, g, or t
nnccnttntttgantcctctacactgttggcctactgacagttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47674 - DNA, 743 bp, Homo sapiens
aatttgagacggagtctcactctgtcgcccaggctggagtgctgtggtgcaatgtcggctcactgcaacctccgcctcccgggttcaagcgattctcctgcctcagcctcccgaatagctgggattacaggcccccggcaccacggcccggctaattttttgtatttttagtagagacggggtttcatcatgttggaccaggctggtctctaactcctgacctcaggtaatccgcccgcttcggcctcccaaagtgctaagattacagacctgagccacttcgcctggcagggaccgtatttcaagtcctgccctcccaccagcgcctgcgccccgcagcagtgtccggctccctgccgacgccctggagctgggacggcctggggcgctggtcggccgccttcccccagaaggaggcgtgagcggggcgtggccggaacgtctctcttcggagccgcgccccgggcgggcacagttacgcgccgcacggatcatggccgcagccgctctggggcaggtgggttcgcagccccgcgccggggtctgggaaataaccgggggaggcgcacttccgggaagaccactggcctgcagccggtccgactcggcgccgctcctcccgccctggggttccgctgcagggcgcggaggaggatggcgccctttggaaaggagcacgaggctttaatggggggggagcaggtagacgcggatgaggtggggcaagtaattggcggggaggt

SEQ ID NO: 47675 - DNA, 423 bp, Homo sapiens
tttttctccatctctctgacccagctgctaaatctccccggtgctctcctcttggcctccatctttcagttgtctgtgtctttgtgtatctgtctctgtctgtcttggtgtctctcatgactgtctggagaagtctctgagcctccccacccgcgtgtccccgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgaggtgggcccaactccagggctgggaag

SEQ ID NO: 47676 - DNA, 1752 bp, Homo sapiens
  misc_feature (14)..(14): n is a, c, g, or t
tttgttttttatanaaagtttgttaaaaagaggtggtccggtccggattcccgggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacaaaaaaaaaatagtgacagtgtcatcatgaaattagcaaaggtgggaaaaaaaagtcgacggcgcccgaatttatgtagtattacccccgaaattctggacggtaactcgggggtaacagtttccccaaagggggtcgattaaagcttggggta

SEQ ID NO: 47677 - DNA, 3036 bp, Homo sapiens
tccacaaacagagtgctacctccacaaacaggttcaaatgattctcccaggctcaagctatcctcctgcctcggcctcccacagtgctgggattacaggcgcgagccactgcgtgtggcctctttctatgattagatctattttggcatctcttgtttcttggcgtcaatttctgtttttgtttttttttttttctgtttgtgcgcccctttctgtgtttctttttctcatccttcctcttccatctcttactctctttttttcatcttggctctgagggcagctctcctgcccacaggctggctgtcgcactgtgtttgtctctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcaggtaatcagagcccagttgatcgaataccttcagagaataagcacctgtactcctgggtctggcggaggaggggctggggaactggactcctgggtctgagggaggaggggtggggcccgtactcctggatgtaagggaggagggtctgaggcctggactccagggtctgagggaggaggggctgggggcccagacttcgggtctgagggaggaggcagctagagtctggactcttacttaggtctgaaggaggcgggcctggggtctgcacccctgagctctgggggagcaggacctgtcggtccttggtcttctaaggcctgtcagcacttgggtacccggaggccttcacttacctgtgtgccttccctggttgttttcttgtctgagctgatttccaggctgcgaccaaaggtctctggggtgggaggcgcttgcgtttgactttgccgcagcatggaggagggggcgggagctgactcagctctttccagcgagccctcgtcagggcagggaggggacttggcctccttcaggaccacctgccccgtctagaatggactgaaactgggacagaacaggcaggccagtgggacctccaagtgcaggaggtggcgagcgagctgccagggcccctgctgtgccccactcaccccctctctcacttctttctccacccaatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47678 - DNA, 1559 bp, Homo sapiens
gctggtacggtccgggatgtagggatgccgcagcgctctgggatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47679 - DNA, 1324 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (14)..(14): n is a, c, g, or t
nnccnttntttgantcctctacactgttggcctactgacagttacgcgccgcacggatcatggccgcagccgctctggggcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47680 - DNA, 1782 bp, Homo sapiens
  misc_feature (14)..(14): n is a, c, g, or t
tttgttttttatanaaagtttgttaaaaagaggtggtccggtccggattcccgggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtaccaggaacagataatggcctttcttattgaggccctggagagtgggctttctgtgctgctctgtggcctggaaaaccccttggggctaaatcaccctttcctgggagctcccggagccctggatatgtcttcagctttggaaaccccttcctgtgatcctctgcggctcctgggtgccctgtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47681 - DNA, 1530 bp, Homo sapiens
  misc_feature (21)..(21): n is a, c, g, or t
  misc_feature (31)..(31): n is a, c, g, or t
  misc_feature (33)..(33): n is a, c, g, or t
  misc_feature (43)..(43): n is a, c, g, or t
  misc_feature (52)..(52): n is a, c, g, or t
  misc_feature (63)..(64): n is a, c, g, or t
  misc_feature (84)..(86): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (94)..(95): n is a, c, g, or t
  misc_feature (99)..(99): n is a, c, g, or t
  misc_feature (101)..(101): n is a, c, g, or t
  misc_feature (103)..(105): n is a, c, g, or t
  misc_feature (123)..(123): n is a, c, g, or t
  misc_feature (173)..(173): n is a, c, g, or t
  misc_feature (224)..(224): n is a, c, g, or t
  misc_feature (230)..(230): n is a, c, g, or t
  misc_feature (243)..(243): n is a, c, g, or t
  misc_feature (283)..(283): n is a, c, g, or t
  misc_feature (304)..(304): n is a, c, g, or t
  misc_feature (330)..(330): n is a, c, g, or t
aagcttctctctgtcccttgncttctgtctngncccacaacanatccccccnccactttcaannctgcagacctgcagctggannncncncncnncccncncnnncaagcctccccccccccnccccccccccccccccccccccccccccccccccccccccccctcccccnccccccccacctcccctccccaccccccccccccccccccacccccccccncccccnccccccccccccnccccccccccccccccccccccccccccccccacccctcncaccccacccccccccccccnccccccaccccccccccccccccccnccccccccccccccccccctcccccccctcccccccccacccacccccccccccccccccccccccccccccacccccccccccccccccaccccctcccccccccccctccaccccccccaccccccccccccccccccccccccccccacccccccacccccccccctccccccccccccaccccccccccccccccccccacccaccccccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47682 - DNA, 1042 bp, Homo sapiens
  misc_feature (1)..(2): n is a, c, g, or t
  misc_feature (5)..(5): n is a, c, g, or t
  misc_feature (8)..(8): n is a, c, g, or t
  misc_feature (14)..(14): n is a, c, g, or t
nnccnttntttgantcctctacactgttggcctactgacagttacgcgccgcacggatcatggccgcagccgctctggggcagctctcctgcccacaggctggctgtcgcactgtgtttgtctctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacaca

SEQ ID NO: 47683 - DNA, 400 bp, Homo sapiens
cactccagcctgggcaacagagaccgggcgcagggggagggggagtgtctctgtctgcttctttctctctctctctctctctctctgtatatatatatagtgtgtgtgtgtgtgtgtgtgtgtgtgtgtgtaaaattgatatttagctccagacaaatgggaaattacaaggaaatgccagatttgatatctgggttctaagactttgcagcctaatgcatgtgtcatgctaaaatagaagtagttagacatgtggagttaaatatggtgatggtttctcagatgattaaaatgactgccaccaggttaaggtagttacaaagcagctttctgtaatggcagcagagataataaactgggcaacaagggaggaaccaatttaaaaaaaaaaaagtcgacg

SEQ ID NO: 47684 - DNA, 3597 bp, Homo sapiens
  misc_feature (1)..(1): n is a, c, g, or t
ncgaaggggcgtggccaagcgcaccgcctcggggcggggccggcgttctagcgcatcgcggccgggtgcgtcactcgccaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggcaaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagaagctgtgagctgagcgcccactagaggggcacccaccagttgctgctgccccactacaggccccacacctgccctgggcatgcccagcccctggtggtggggggttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaaggctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatcta

SEQ ID NO: 47685 - DNA, 345 bp, Homo sapiens
caggtgctccagtgtctgcttggatgcaccccaggctgggacggctcagtaagaagggtctgggctctctccctgccctgtcccatgcccttgtcctcccagagttacacagcttagggcaggctgggaacttgctgcctcttcatggggcttcctggtatctgattactgaccctcgcctgtgtcctcccaccactgccacctgtccagagtgaggcagcagctccccacacagatgcaggaggtggactctcttctgatgaagaggaggggaccagctctcaagcagaagcggccaggatactggctgcctcctggcctcaaaaccgagaagatgaagaaaag

SEQ ID NO: 47686 - DNA, 3721 bp, Homo sapiens
  misc_feature (1)..(1): n is a, c, g, or t
ncgaaggggcgtggccaagcgcaccgcctcggggcggggccggcgttctagcgcatcgcggccgggtgcgtcactcgccaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggcaaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagaagctgtgagctgagcgcccactagaggggcacccaccagttgctgctgccccactacaggccccacacctgccctgggcatgcccagcccctggtggtggggggttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaaggctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatcta

SEQ ID NO: 47687 - DNA, 126 bp, Homo sapiens
gaatctgggcacttgtcacagctgggtaggaaacttggatttgccatactctatgtttaaagattacaaagtctgattaagtgccaaaaagagtttttaaaaatgttaatggttcacttttcacat

SEQ ID NO: 47688 - DNA, 460 bp, Homo sapiens
gtttctttgataaggagagtatcctgaccaaagcacccttttcaagtctaaccacctggtagatgcaggaacatccttgtagattcagcatcttttccactgtgtgtggttacagccatggagaaaaagttacatccctgtacttccactgatttttttctttaataatactttccgtgttttaggatgttagatatcagagatttcacaagctctgactgtaataggagaatgcataatgtgaattatgcactgcagaggtgagtacacaagttggctaatgataggttacatggcttgcaatttgggagccagaagcaagtcagcccaggggatccctgtggtgtggagcagctctgtgtcttgactatggtcatgggtgtacaaatatagatgtgatgaagctgtatagaattaatacgcatacacacacacacacagagtacaagtaaacctgggg

SEQ ID NO: 47689 - DNA, 430 bp, Homo sapiens
gctctgttgcccaggcagcacactgcagccttgaaccctgggttcaagcaatcttcctgcctcaacctcccaagcagctgggactataggtgggcaccaccacacctggctaatttttttaatttttagtagagatggcatctcactatgttgctcaggctggtcttgaacccctgagcttaagtaattctcctgccttggcctgctttaagaattatagaaaaggctatatgtaatcttttgtgatttacctttttcattcaaaaatcatgtttttgaatatgagaagcaacacgagtcaaccattcaaaaagattataagggtataatctaatatccagtccacactgaaatttcccaagttatctaaaaaatgcagagatggggtctcatcttgttgtatagctggagttcattcgactgctatata

SEQ ID NO: 47690 - DNA, 661 bp, Homo sapiens
cctctgtctggccgccagcctgggctttctccagctgatttgtagataaaatctctgacagtggatcttttacccaagaattgcttaagatgttcttcagatcctcaatttcagcagaatggctgacaccaactggcatgggtgagcccagagagaggctgggaattaaaaaaaagtttacttagagaacaagcagttgccagtgaaacgttggtgcactgtagacttcagacataaaaacagcagccatcactgacttctggcaaattcaagtaaaacaacaaacatcgaaacttccagacattctgttgggggaagttgccaaagacgttggctgccatagtcagctttaccatcttcgataagaaaatactcctcttcaccatatacaagaatttattaagtacctgctttgcctacaccattttgcacttagtatgttttcgttacatatttgataggaatgagagaaagggcacaggtgggcccctcagaacagagcatttaattgagtacattcggagcatattttgagtatgaacctccctaacaacacaccttttaacagtgattcaggggaaagattcagcttttgtggggtctgaagtttgtacagtttcaagagcccttttaagaggaaaaaaatacaaaatcacaaaag

SEQ ID NO: 47691 - DNA, 510 bp, Homo sapiens
caggaaactgagcaatcattcaaacccatgtctgtctgaatgcaaagcccatattcccccaccccaccctgcatctgtactgcttctcagacctacagagattattagtaccatctctagattgtaaactgatggagggtggatttactggttcattccagaaacctagggctgagtttatggaaggctctgggtagccaggtgcctcttcctccaccaaccagcagtgtcctaatgggcgattatgtagtaatgattcggcactgtggacaacagcatctagaggtgcatacacctcatgcctagcccagacaatatgtccctggatggcctcctctaccccagaggtgtctagaacccagtttgaaataaatacttcattaatattcagtaacctttacaatgtgacagatggtcctaaacaacttgcacaaattagctggttgactcttcataacaactctgttaggtggatacaaatattatgctcattttaaagctgaggaaact

SEQ ID NO: 47692 - DNA, 325 bp, Homo sapiens
gggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggt

SEQ ID NO: 47693 - DNA, 370 bp, Homo sapiens
gagacggagtctccgtctgtcacccaggctgaagtgtagtggcgtgatcttggctcactgcaacctccgcctcccgggctcaaacgattctcctgcctcagcctcccaagtagctggaattacaggcacccgccaccatgccccgctaatttttgttatttttagtagagacagggtgatggtcttgagcccctgactttgtgatccacctgcctcggcctcccaaagtgccaaacttgggtttctgtaaagcaaaccaaatcatttggatagcagaagtgatgtactctatgtataagtggcaatttaagggcagaaaagaaaaaagagtatatatatatatatgtaaatattgcatttatatatatgt

SEQ ID NO: 47694 - DNA, 380 bp, Homo sapiens
gagattagaggccaggaggaaagtaaggttgtggagggccaaagcaaagtgtttgtgtgtgtgtgtgtatgcatgtgtgagtgcatgtccgtgagtgtgtgtatatgcacgtgtgtatatgtgaggctatgtgtgtgcatgtgtgtatgtatgtgctcatgtgcgtttgcacgtgcgcttgtgtgtgcgtgtgcacgtgtggtgagtgcatgtatgtcagtgcatgtgtgtgcgtgtgtgtatgagtgcatgctcatgagtgcatgtgcacctgtgtggtcgtgagtgcacgtatgtgcttgtgcatgtgtgcctgtgcagatgtgtatatgagtgcgtgtgtgcgtgtatgagtgcgtgcgtgtacacatgagtgcatg

SEQ ID NO: 47695 - DNA, 551 bp, Homo sapiens
agctggtgaaggtccattactgacgctctgaggcttggttgaatggaacaggaagacctgaagtgaaagaggagctttgacaagctcctggacgctgatcagagcaaagggagcagacatgtggcgctcagcacacggaagagtgtgtagagcagagtaagagcgcctggaaccctgaagcttcctctaggccctcccactgcagggcgctgtatcagaggctggagagcctagtgtcaagcatatttcagtctttgtggaacttggcatcctgtaggctatattttgcccctgggcatgtttgatttagcttatataaaatatttttttaaatattggagccagtgtttgtaagttaggttatttcacattaaaaaaatatcttgaaaacatagaaggtcaggaagcgcacagacggcatctacctacagcaacagtgtgggctggtccctttgggctctctggcccgggctgtgcgtgccagtttcacactttccagccgtggcccctgcactcatctttgctacctgcctccataaatatctgagttt

SEQ ID NO: 47696 - DNA, 319 bp, Homo sapiens
cttgccttgagaagtattacacatttttcaaataaaaatccaccaaacagcactgtacttttaacatataatcatgagactgctttaataccccatttcgtaatttcagccaagcttattaacagaaatgccaaaatacctttcattacaacataatttgttcacaacatgtccatttgtgatttccatttaaggacaataggtgagtctaagaaatttgctttcaagatctcctattttcctcactcttgtctgggtgtgttcagctattgtctgattttctctaacccctctaaccttttttcttggagagaatatg

SEQ ID NO: 47697 - DNA, 610 bp, Homo sapiens
agttactctatttttttggtgggaggacaggatttcattctgttgcccaggctggagtacagtggtgtgatgtgatcatagctactgcagccttgaactacttgtcttttaagtgattctcccacctcagcctcctgggtagctgggctgcaggtgtataccaccatgcccagctagtttttaaaatttatctattttttaaaatttttaatagagaatagggtcttactgtgttgcccaggcttgtctcaaactcctggccttaagcaaccctcatgcctcgacctcccaaagtgctggtattataggcatgaaccaccatgccccagcctgttctattttattattaattattgtcgttagtctcttagtatgcctaatttaaaagttaaactttattataggtatgtatacataagaaaaaacatagggtttgttactatctgtgatttcagacattcactgggggtcttgtaatatatcttctgcagataaaagggaactactatatactacttctttttccatgttaatgtgcagtctaggatctgtactaagaagttgaataaaaatggtgattttgggcattcttgccttcttgatttaaaga

SEQ ID NO: 47698 - DNA, 427 bp, Homo sapiens
aatatagtcctaatcaaaattttctagctctttattttacttatattttgggggactcatcagttatgattaaatgggtcaactagtaacagaaatctaagtaatacttgtaaactaaatagaattaattttcccttgatgtagaagtcaagaggctggtatggtgatgttgtgatttcatcagcctctcagtttttctcaatccttctattctgcgttcctattctgtagcttccatcctcaaggtcaagtcatggtctaaagatgtctgtctgtctattgcagctccaaccatcacatctgagttttagaaatagagatgtagaaaaaaagaaaggcctgtcaatggaatgctttctgcttctctgaagtccctcttaaaattgtttaaattttaacacctatctacaagggtggctaggatatg

SEQ ID NO: 47699 - DNA, 448 bp, Homo sapiens
tgccatattcccttggctagaatcaagaaacaggtcctgtccacactcaagggtaggggatgtcagtgccaggaggctggaatcactgggagagtctgtctacaaaaatgaaaaaccaaaggtttaatgaggtgaaacagtcaaagtaaacacagcagtttgtgttagcattaactgctgcttctgatgaaccattcaggaaagcacactctagacactagtatattgaggcacataggacactaaagattgaagcagaaattgagatgtcccccccacgcctgtttttcccaagaccagctatatctctcatctacgcatgatttcagtgttaagtctatcatatgttaccccctaacaagacattcttagcacaactgagaggggcaccacaggtgagtcccaagatttttcttgtaaatcctcacattctggatctctcaaaaaa

SEQ ID NO: 47700 - DNA, 414 bp, Homo sapiens
gagaatgtttgaacccgggaggcagaggttgcagtgagcagaaattgtgccattgcactccagcctgggcagcaagagtgagacaacgactcaaaagaaaattacttacttatttttgcatgagaccctggccttttaggatacaagtgaaccacaatgcaatacagaagggtcacggcatgtaaaactgcacattgttcctgtctgagtcgtgatgaatggttttggacagtatttattggcatttttaatttctactagaaaaacattcggaaacatatagtcatgtgtatcacctttagttaataattggctttttaagctgtcactaagaggtcaatgaaaagggaatcactgatattttcttattcccagtttctgcctttaactttccagagacactggagactgttg

SEQ ID NO: 47701 - DNA, 470 bp, Homo sapiens
gctctccagggctactccagctgtgcgcggtttccacctctgcagctggtattccagtcaggggaatggggacaaggctgggatgggggatggggaccagggtcaagaacaaaacgtggtgctgttcactatgattaattaacccagcaccagagccccgagccgcggtgctaaaaatacctgcttccctctgagatgcggcagctgccacgcagcaacttttacccacgccgtttgtcataatctgacactgctaaggagtgtccacagggccgtgcgtctgcaagaatcggactcatccgcagtccaccagccagctggtcctcggaaaccatccacggcgctgtcctaccttcactctcctcccatccctgagcccagccaatgtgcctaccacctgccactgcctgccggttcgcagctcctcctggaaccgagcggaccacccccagaggtgggagccaaagctt

SEQ ID NO: 47702 - DNA, 365 bp, Homo sapiens
gcacctcatggcctgacagcacatatgcatttatttgttgtctacctcctcccaccagaatatgagctcaagagcacggggactgttgggctgtgttcactgctgggcctccagcacctaggacggttcttggcacacagtggaggcgcagcattgctgaatgaatgaatgtgattaaactgggaggaaacaaaattaaacatttatcaaatctctacctaagctaagaagtcttagaagaaatcaaagagatggattaaccaatttgattaaaaattttaaatatccttgcttttattttttaattttaattttattttttttcagacatggagtcttgctgtgttgcccagcctacaaactcc

SEQ ID NO: 47703 - DNA, 168 bp, Homo sapiens
aaagtaagttttgtgatcgaagggacggctttgttttctacatgtcctagcacttaggaggggtgccttgagcacagcaggtgcacaatcaataattgttgaatgaataaataaacacaaagtggctggaatcttatcagaagccaaagcaataagagactccccatg

SEQ ID NO: 47704 - DNA, 388 bp, Homo sapiens
agaagcgagcaaaagttcctttactgtaaggtcacttggaaaggtcaatagaaagcggctgttaaacatgatgttattctcagtgaaactgtatgcatccaagagaaggaactaactttaatgtttcacactgaagaaattgtgtgagagatacaagtacctttgtgactattgatttttaaagaacttttattgagaattcactgaacttattttaaattctctatgcaaagcttttctcactagggtagtttcattattctacatctggcaggcacgactttcaatgaatcagaaaggaaataaagttaactatgccttgcgcctggtagatgagaaagcagcctctcaagtcaccctttttcatagcgttttctctcttgggatg

SEQ ID NO: 47705 - DNA, 387 bp, Homo sapiens
acttccgcctcccaggttcaagcaattctgcttcagcgtctccaacagctggaattacaggaacgcgccatcacgacccgctaatttttgtatttttagtagagacggggttttccgtatgttgcccaggttggtctcgaactcctggcctgaagtgatctgcccacctcagcccccaaagtgctgggattacaggtgtgaatcactgcacccagccaaatgtttgtatttctttgacattattctttccccaactactgcttaagttgagtgctcaaataattgacttttaattttcacatatggtataggttcccgtgtgttaagagggacggttaatatcctaataatcctcacaaaggaggaaaaaaaccaaacacatcatcc

SEQ ID NO: 47706 - DNA, 694 bp, Homo sapiens
gaaaataagggtctgagagtcatacaagctgggaaaagggagaggccagcctgggacccaggctcaggtagggaaggggaattggggcctgacaatatttgaacccctaatgttcgtactgatctcattggatcttccaggcaaccatgtaaggtcaatctcattatcctcactttatagcattaactgaggctcagagggatgaaatgactattcaaagacacaaacccaagacactcaggaaggtacaaaaatgtccatgcgctcctgaaatcatctgcaaaatgttttatgtttgtacttgtatccatttcccagggtaaggagcttaaaactttcaaaggattctccaaggggtcagtgattctcaaagattaagagccactaatttaagccaaggctattctgattccaaagcctgttctctgaggccccctgtgccagactctggttaagagaacgttctttaaagtcaaactcatataaaacccagatcgtactagctgtgagaccttatttcctcatctataaaatagggattcagccaggcgtggtggcacacacttttagtcccagctgcttggaaggctgaggtgggaggatggcttgagcccaggaggcagggctgcagtgagctgtgattgtgccactgcactccagcctgggtgatagaacgagaccccgcctctttaaa

SEQ ID NO: 47707 - DNA, 744 bp, Homo sapiens
agtaaacccctttaagctgcagacatccagggagttcacactcactagtgtgagaaagactggaggcaggagagagattgatgacagccttcctcagtggtgtgagcctggaagaggagatagctcccaccacaaaaaggcagggggccttaccaacccttctccatagttaacgaaagccttcagttgctgaggaagatcagcaaaccctgtcagcttggggcactgcatcttgggtagggaaaaaattaaaacccactactcctgtggttggagcaggaaaccaacctgggcctagcacattagaggtctcctactgctgggagaggggtaggaccactgagaaaagccttatccttgagacacagggttggtcccagggctgcctaagactggggctagagcctccttttggcacctaccaccacttgctacttagcaagcactaagtagcaagcaaaagcagtctactgctagggggaggaacaagcatgtggagataaactcctctgaggtgcaggcactcagggaaggatgaaagctgaggacaaagcaggaaaactgagaaaaacactctggcaccctaggaaaaaccagctatatgctgtctaaaagagacacaccttaactacaaagatataaataggttgcaagtaaatggacagaaagagatacaccatgcaaacagtaagtataaggaagcaaacaaaataagacatcaagacaaggaatatgattagaggc

SEQ ID NO: 47708 - DNA, 1988 bp, Homo sapiens
gattacagacatgagccacctcgcccagccttttcatagctgagtgatattccattgtgtggatggatcacactagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccgcccgacgccttcatccacgtggatgacttccagagccccaaggacctggcccggtacctgcaggagctggacaaggaccacgcccgctacctgagctactttcgctggcgggagacgctgcggcctcgctccttcagctgggcactggctttctgcaaggcctgctggaagctgcagcaggaatccaggtaccagacggtgcgcagcatagcggcttggttcacctgagaggccggcatggggcctgggctgccagggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgcccaaggtgtgcagggcaggtcagggaagggcagggtcccctaaggaggagggcgaagggtatgtgtgtgaccatcagcagtggtgtgcacatggctgggggacactcggtgtgagcgccagcggatgggtgtcacaaatgcatcactgtgggtgtgacctcggcgtgactctgatagtgcctgtggatgtgttgcgatgcctcaccctggaggcactgggccctgagaacgggtgcccttgaggccctgcccccgggcgatggtgcaggctggtttgcttgtggttttattgctgttgttaaccacccatgaggggtgcaaacagataatgctgttaacattttca

SEQ ID NO: 47709 - DNA, 903 bp, Homo sapiens
tgcctgttggatagtcatcgggtggtttttgctccttctgcattcctcagataaggaatttttgtctctagggcctgttcagtggtcaccaagtgattttgctctcctcagatctcagcccatattttaaactgtttcccaatttaactatctattgaaatcaccattggaattttttttaggggaaaaattctttatttgtcctgggggaagaaaaaacaaaaaatgttattcttgaggaatttttgtgaaactctggatggggataagactgaattcagggatggattgcctaatccaaaatttatcgtgtgcagaggggaatataaaaagtcactaggacgatataagacccatatacaactctgtagcttgggcagcagacctggaagaagaggcaacttgtgggactgcctaattgtgcaactaattaggcagtaaagctcgatcctgaaatgtcttgaggaaatgccttctgtgctagatctcacaggcagctgggacagtgtagtagtatctactcctgcctttctcttagcagcaagacctgtaaagaaaagctcaagctttgctgaaataacttctaacaacaacgcctgtgttggttagagggcgggagcacagtgcatgctgttagagcaaatgcaaaaattaaatccctatagtaggtgatgatgctgcagtgatggctctccacctaggtgatgatactgcaatgatggctctccacctaggtgatgatactgcaatgatggctctccacctgtttctcacagttaacctgaatccatagctgagattaactgtgataaagaaaaatcactaacagatgaaaactttcagtgattcggagaattgtacctaagaaatctaaacaaatatttcctttaaaatgtcacagaa

SEQ ID NO: 47710 - DNA, 454 bp, Homo sapiens
accaagaagataaaagtagttaatacctcagctttggtcatcctcacaattcgtgaggctgatttacttcagattttgctaaagataaagtgggtccccaaatcagggaagtgttaaacctatgctaccagaacacaattttcagaaattcaggatgcatttatccatgcctgtagctagctactttctcaatatgccttcatctactgttgactgcacaccagctctgatccaggtcggggcattgagccaggtggtgttaagggaaacaaggataagacagagccagtgccctgtgccttgggtaattacccacaaaactgtaacacaaggcaaaccgggacaaaggccatgggaagagctggtggaagacctaggttgactgctgacccatggtgatctctgcagccacggacagagaggaatgtgttccagtcccagaggaccagaagga

SEQ ID NO: 47711 - DNA, 366 bp, Homo sapiens
tattttgaagctcacaatttgcataaatgtttaggattgttattccttttcctttttctctttttttgagatggagtctctcactctgttgcccaggctggagtgttgttgatggcaacagtgggccatctggaccatctggagtggccactgccaagatgctggctgcagccaggaggctctgcccatgctgtgagcttcacagagccagagggagcggggacaagcaggagcccagctccttccaagttggcgggtgggagctccccaggcatagctgcagctgcccaagtcatggctgctggctgagcctccctgtgttcttggagaccaggagcaggcaggagccctgctctcctgggtgca

SEQ ID NO: 47712 - DNA, 457 bp, Homo sapiens
ataagccactctttcttccttggggtgcaatgaggaaaggcttacttgaatgaatttccctcaaaatggaaacatgagacttaagggaaaggaggttcctacctaaaaatcaatagttatatatcaaattgaaatatgtatcatagatcttgtttcaaagtagaagtactgccgtggtggctcatgcctgtaatcccagcactttgggaggctgaggcgggcagatcactaggtcaggaatttgagaccagcctgaccaacatggtgaaaccccgtctctatgaaaaatacaaaaagtagccaggcgtggcggtgtgcacctgtggtcccagctactagggaggctgaggcaggagaatcgcttgaacccggggagcagaggttgcagtgagccaagatggtgccactgcactccagcctgggtgacagagcaagactccatctcaaggaaaaaaaa

SEQ ID NO: 47713 - DNA, 291 bp, Homo sapiens
ctcaagtcctatctgttcagtgacttcttccttctcctttccaatttatagaatactccttagccctgccacacattttatacttccattgtgttgaatctatctttttatatacggatgctttagtttaaacttcagattgtaacctccttgaggaaagggcttggattacagattttacttgtattctctgcagtgtcttataatagatgttcaacaaatgtatatgttgatcaattgaaatgataatagaacccttaatagctgaagatatgtaacgtgcatctaaga

SEQ ID NO: 47714 - DNA, 289 bp, Homo sapiens
caacccccctttttaatgaaaagcttatggaaagcaagactatttctattcagtgttgtactatggtatttgtgcacagcaggtctggccttttttctcctaggagttttctttttgttttccctactcattattacatactggcttttgtaatcttcggtatttcaaaaatcacattttacgctattagcaaagtcaacataaattaagttagctaagttgggtttttcattttattaattattggactccatggtaaagagtggggtggtgctatgtaatctgaaaa

SEQ ID NO: 47715 - DNA, 494 bp, Homo sapiens
ttcctttctctgggaattcccttggagaagaaatctggctgatcaaatctccttgtaaacatgctgtgaagactctgggggaaaccactaatgatatttgttagtggcagtctttatctttgagagacttttagcagcatgaaccttacccccgtagttagaattgtatatggtaaacaaacctggaatctaaggattcatgggtaatggcttcttgaaaagtgtcaagtaagctatgtaactatggcaggagatggaactacttcagggttaaaaaagctggctttcatttcgtgcaagtaatgtacttgtgtacatcttttggagaaccatatgttaaatccgaatcagaccaagtcctaatgtggtaagaaaagggctgtggagtagtattggcagtcctgggcttttccctatgttccctgtaccttgtgattacttatagctttgacattattagtaaagcttgatacttggtaaaataaaaaaaactt

SEQ ID NO: 47716 - DNA, 823 bp, Homo sapiens
gggtcaagcctagggcagaattacctggttgggggtgggaaggtagtgtcttgtaaaaatcagatctctgggttctaccttcagcgtttctgattcagtaggtctaggataagctcaggaacctgcaattttaagaagctaccacctaccaagtaagtcaaagaccacacttttaaaattccagctacaaatcagcagttgggaagagaaagtataaccatttaatcaatttcaaaaagctgatattctagtacagtaattctatacactggagtagagggtatattttgtcttccaggaacatttggcaggatttggagacattttggttgtcacatctgagataatatcattggcatctactgagcagatgctaagcatcctacgatgcacaggacagccccccacaacaaaggattatcctccaaaatgttaacagtgtcactgagaaactctattcatgaggatattctgctctcccaacaatggccccccaccccgcccatcagccccaatccattggaaatcagtgctacacagtttaggtcacaatgcagagacttatgcgagatcccctgaaaaacttttgagaccccagaaatcttttttaaaatggtgaatttcattaaagagatagaaaaggagaagattagaactgacaataaaggaaagtaagtatgggcaacaagggtgaaccaaaaaagggatcaaaggaggctgaggcgctgagtgacagcagcgggaaatcaatgctgcccctcagtggacgcagcccatttgtaaagagatgataaacccatgaaaaataacaggcacaaaaaat

SEQ ID NO: 47717 - DNA, 492 bp, Homo sapiens
  misc_feature (1)..(1): n is a, c, g, or t
  misc_feature (7)..(7): n is a, c, g, or t
naatttngccctcgaggccaagaattcggcacagccatgttggtcaggctggtcttgaacttctgacctcagtgatctgcctgcctcggcctcccaaagtgctgggactataggcatgaggcactgcgcccggccatgtatttattgacaggatctagctatgttgcccaggctggtctcaaccttctgggctcagctgatcctcctgagtaactggtactacacgtgtgagccactgtgactggttcgattagggttaaatttatttcaatacccatattgtgggaaaccaggaatttgcttgcttgtttttactacatttaaatttgttatggaaatttaataatctctacaaatacagacagagcagtgcaataaattttcatgtacctcatgaaaatacctcacccaacctcactggttatcaactcatggccaatcttgtttcctctataacctcacccactctcttctcctatattatttttgaaa

SEQ ID NO: 47718 - DNA, 231 bp, Homo sapiens
taggaaatgccatgcaaccaggaactactggacatgactcttccagctcatgatctaacccagaccctgcccctctttagctgtagttccccgtttcccactgctcgctggacagtgctacttggctatctctgtgtcttcttaaattccatgtggtaggctgggtgtggtggctcatgcctgtaatcccagcactttgagaggctgaggtgggaggattgctttgaggcc

SEQ ID NO: 47719 - DNA, 315 bp, Homo sapiens
accccctttccatacacaaaggtcagctgaagtagctgaaggataatgaaatagtcctctgttccttgattatgagctgatagcaatcatatgaagttcaacagagatgaagtcaatgcacataaatataaaagtattcattgatgttaaccctaacattaaacaggttcaggaaggggtaggcctggtttgatagcagctcatgtgaaaaagacacagaggcaatgcatgtgtggggatagggggaatatgggaaatctttgtacctttcagtcaattttgctgtgaacctgaagctgttctaaaatgtagtct

SEQ ID NO: 47720 - DNA, 365 bp, Homo sapiens
agaggcagaaacctttctatcaaccctggcttccaggggtcagctctagccttccactgtattccctggcttgattcttcagcataaggctgcaaaatctgtcttctgagtcacatagagagacctacagcaggatcaagatcaagcaatatctatcaccataaagacacatttgcataacatgttatacttgaataaaacttaaataatacaatttagagaaaattccattaaatgtgatagagctgatgggcatgctatgaaacagaacataattggagcaaatcttccttgtcactcttggtctttggagatgcaatagaaatcctttgttaacctcctaataaactgttattcaaaagtta

SEQ ID NO: 47721 - DNA, 580 bp, Homo sapiens
atctagatgatctgtgtatgggtggagctctggcaatagttactacaaaggtcgacattcagatcttctgaaattattacagcagtttattctttcatttagtatagtgatcaaatacctgctatctgcctggtgctattctaggctccagataaggacccctgcttcagggagctaacattgttgtatgcatgcagaggggaaaaggaaagggagtgaacctgaaaataaacaaatataatatgttttaaaaaaagatacattgaatcatgtttaagtatgaacaaattaaaatgaagagaggtgatggacaaaggctaggaaaaagaggctggctttagacacctaaaatctacagatttcagaagattttttggttgtgaccagacagctaaacagtctgtgagtactttggcaagaacataaatggcgtaagaactgctgtgtccatatttttgaaagctgactctaagtcaggagaaataactatcttctgtgaacccgggagaagagacgtatccttgacattagctgaggtcagtatggccagtcaattcttttctctgccaaaaaaaaaaaa

SEQ ID NO: 47722 - DNA, 597 bp, Homo sapiens
  misc_feature (592)..(593): n is a, c, g, or t
gcagccgccatcatgcctggctaacttttgtatttttagtagagacggggtttcgccatgttggccaggctgatctcgaactcctgatctcaggtgacccgcctgcctcagcctctgaaagtgctgagattacaggcgtgaaccaccacgcccggcctgattttatattaatataaacaaagattcatctcccagctctgccactttgtgaaggttaaggtgtcacttagcctctccaagtcacagtaaaatggaacaatggcacctgccctcacagagctgctgtgaaggtaatagatcatttgctgctaggacctggcacatgcagccttgcccaaatggtggctgttattactggaagtttccaggccaaggaaggctggcatccacagcccttcacccaaagcccaccaggaacacacttgtagttagtctagtttggtttcttgctctttgcagcgagggaactcacatcaggggaacctcgggttgcctcagtaggaagaaagaaaagaaagaaagaaaagaaagaaagaaagaaagaaagaaagaaagaaagaaagaaagaaagaaagaaagaaagaaagaaagnnagaa

SEQ ID NO: 47723 - DNA, 383 bp, Homo sapiens
aagtgctaaagtggtacccctttccagaagatgattgtttatctaggagtccaagcactaaaagctttcaaacaagagtcacttgacaatttttaaaatgataatttccttaaaaaaaaaagactgaaattgctgaagagtaatttgccacaatgtgcagagcatagagatggtgaagtgctgtgaactacaagtaattgctcttaatgtcatgatggcccagttggttcagtgttgatagggccttgcaaatcgtgtagaacaacaacagtgtgtcctagcagtctcagtgtctatgacctggaagtccaggtttccatattagtggtacttctgaagtttagaaatcttaactctaaaagaatccaattattttcacaatc

SEQ ID NO: 47724 - DNA, 763 bp, Homo sapiens
  misc_feature (3)..(3): n is a, c, g, or t
ccnacctcagtatctcccaccttagccttccgagtggcaggaccacaagcgtgcaccaccctgcctgtagagagggatattttgtagagacagggtctcactgtgttgtccaggctggtctcaaactcctggcctcaagcaatcctcccagattgctgggattacaggcatgagccactgtgcctggctggttctgtttcttctctagtcttacttctgtcaggctcacttacctgacttcatgtagaagcattcttcctggatccatgttattctcttttctgctaacctgatattctctttctagcagtgctagttacttgtttctttcagtattcagcatatatagcttttcgtgactgcttcagattacactcaaaattccacctgcacaatgaagcagataccacctacggacttccaccttcccttatttccccttccatttagtcaggggcaccctccactccacctgtgtatggtttgtatttactttaggttgtctttaagttctaaactcctcaaggcacaatttgattttgttctcttgatactgtgcctaatacctttgtatttcataaataataaaatatacatatttcttattttttatatacaataattttgtgaggatgtatttaataatgctaattaacaaagcaaatactgtacctaaaacaaaatgcatggttataattgtccgtttggttttttatttttattttttttgagagtgaaagtttattacaaatgaaagatttga

SEQ ID NO: 47725 - DNA, 455 bp, Homo sapiens
acctcatttatgcctttaggggactttttagtttttcttagttctttaacaacagatgctgtgtatctaatagacttatcaaacattcattgagcattaaggaataggagatccagtaacttctagcaaggatattatagtttatttgaagagacacaaatcaaaacagatttttgttggtaaaaacctattttgccaggcttagtggcttacgcctgtaatcctagcactttgggagtccaaagtgggtggattgcttaagtccaggagtttgagaccaacctgggcaacatggcgaaaccccatcactacaaaaaaatacaaaaattatctgggcgtggtagcacacacctgtaatcccagctactcagaagcccgtggcgggttgcaatgagccaagattgtgccagtgcactccagcgtgggtgacagaaagagaccctgtctcaaaaaaa

SEQ ID NO: 47726 - DNA, 493 bp, Homo sapiens
taaaatggggaggaaccctcagttccaggaattgcccacccctttcctggaaaactcatgaataatccaccctttgtttagcatataaacaagaaataaccataaaaatgggcaactaggtgtgcaccactgctcttcttatggagtagccattctttcattcctttactttcataataaacttgctttcacttaaaaaaaaacttgacccttaccttatgccatgtataaaaattaactcacaatgaatcaggaggtattcctttttcctgactgcctttgaactgggacatcatttttttccctgtcttcagacttgaactgaaacatcagcttttcttgagtctcaacctgctgttctttggactagaactgcaccattggctctcttgggtttccagcttaacaactgtagatcttggaacttggcagctttcataaatacatgagttaatttcttaaaataaatatattcatatgtatgtatataaaa

SEQ ID NO: 47727 - DNA, 1090 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47728 - DNA, 1871 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggtgggtctgtctccttccgaggactgcgatgctcatacacgcacatcattaagagctctgcgtttgggaacaggcatagcagagattataatttcaagtattgaaatgatttcaaaactgcttttttcaaaattggtattaagttccttaaccacagatcttttgctctcgatgtgagccagtggtaaaattaaattaaaatgtggggtatttttgccctcccttttattctttctaatggacatggaaatgaacatcaaactgggagaaagaaccatttaacatttaattaatttaaaatagtgtattgagcaccggtatgtgctctggccataaaagaattcacagtccaaaactaggagcaaggcagcaaacatcatcttctccagtgtgatgatatataacagaggtttgtacaaagcgctgtcaaaatacagggaaataactgcctgtgagtttgtggaatgcttcacaaagacagttgatctgagccatcagcaagaagtcaagttgaaggacaaggacagcagtacaaaatgtggattatgtcacaatctggcatagttggatctgtgagtttaaaatgaaatagttactgctgagataccatttcttctctttgcaaggatacacatattcaacatacacaagagaggaatgtaaagaagtgcctaggcctcctgttttattgttttgttttgttattaatcttcattttcttttggaatctgcctaagagttatggcaactgatgatgagaaactaagactaccaatgttaagagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47729 - DNA, 1249 bp, Homo sapiens
atcccagcatgcattattaagcgcttgacttgcttccagacaaaggttgtctcaagtttgttgctcaaaccgagttctggagaacgccatcagctcgctgcttaaagggaaatgctgttgtgagagagaatgaggagagaactaggtaaggctgtgagagccatcagacctcgatgcaagtccacccgcgagggaggaaaagaaggaaaccaggttgagtggaagcatcccagacagctgtgcagtctaagagaacttcagcaagattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47730 - DNA, 2148 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggtgggtctgtctccttccgaggactgcgatgctcatacacgcacatcattaagagctctgcgtttgggaacaggcatagcagagattataatttcaagtattgaaatgatttcaaaactgcttttttcaaaattggtattaagttccttaaccacagatcttttgctctcgatgtgagccagtggtaaaattaaattaaaatgtggggtatttttgccctcccttttattctttctaatggacatggaaatgaacatcaaactgggagaaagaaccatttaacatttaattaatttaaaatagtgtattgagcaccggtatgtgctctggccataaaagaattcacagtccaaaactaggagcaaggcagcaaacatcatcttctccagtgtgatgatatataacagaggtttgtacaaagcgctgtcaaaatacagggaaataactgcctgtgagtttgtggaatgcttcacaaagacagttgatctgagccatcagcaagaagtcaagttgaaggacaaggacagcagtacaaaatgtggattatgtcacaatctggcatagttggatctgtgagtttaaaatgaaatagttactgctgagataccatttcttctctttgcaaggatacacatattcaacatacacaagagaggaatgtaaagaagtgcctaggcctcctgttttattgttttgttttgttattaatcttcattttcttttggaatctgcctaagagttatggcaactgatgatgagaaactaagactaccaatgttaagtaagttcagcatttcaattaagtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagca

SEQ ID NO: 47731 - DNA, 1056 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatattaatctctttgtaatctcttctgaaatcattgtaaagaaataaaaatattgaactcata

SEQ ID NO: 47732 - DNA, 976 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47733 - DNA, 677 bp, Homo sapiens
gagaacgccatcagctcgctgcttaaagtaagatttcctaatacttttgaaatgaaactttagaacggaaagaggggaggtttaatttttagatgttgtttttttctgcacgttgcctgtttcaaaattaatctgagcagttagatcagtgtaaagatgggtttttaaagagcctgaaactctgtggtatgtatgttttataaagtagcccaagaaaaaaggattcttacggtatcctaagtgaagagttttcttcctggctcttgaaaacaatggcttcctgaatatgctgtttgtgtctctgctaatcaaaaatcaacattttgattctaacttttggactaaggaagccaacatgtatggttttcacattggatatattgagaggtgccttgttttaccatttcaggccgtgtttgctctcattttctcaaagaaatctgttttagtttgagattacagtttatcaaatgttaaggctttgaccccaaaatctggtcccagaaagacaggaaggccagctaagaggaggttttcagagtgcatagaaaggctgctctgtgcttcggcatttgttctggaagtgcttcttcggttggcaaagattcctagcaaaacctttgactggaggctttacagggccatacacccaatatcactaatgacagtgttgtaaa

SEQ ID NO: 47734 - DNA, 478 bp, Homo sapiens
tcattttcttttggaatctgcctaagagttatggcaactgatgatgagaaactaagactaccaatgttaagtaagttcagcatttcaattaagtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggtgagtaaggcacacctgttttgtaagcaaagttttactgaaacacttccacacccaa

SEQ ID NO: 47735 - DNA, 490 bp, Homo sapiens
cagaggccatttagttccagatcacaggacactcagcagttctaaatcaaccaaatgttaatttggatttccctgaattaagtgtttaagtgaggtttcctgttaggacaagggtaaattgtttagttatcctagtcacaggaaaatttcaaaatacagcctgtatcaaacctggttaattgttctgtctccttgtgtttatcactgcagtctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47736 - DNA, 1131 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagca

SEQ ID NO: 47737 - DNA, 2107 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggtgggtctgtctccttccgaggactgcgatgctcatacacgcacatcattaagagctctgcgtttgggaacaggcatagcagagattataatttcaagtattgaaatgatttcaaaactgcttttttcaaaattggtattaagttccttaaccacagatcttttgctctcgatgtgagccagtggtaaaattaaattaaaatgtggggtatttttgccctcccttttattctttctaatggacatggaaatgaacatcaaactgggagaaagaaccatttaacatttaattaatttaaaatagtgtattgagcaccggtatgtgctctggccataaaagaattcacagtccaaaactaggagcaaggcagcaaacatcatcttctccagtgtgatgatatataacagaggtttgtacaaagcgctgtcaaaatacagggaaataactgcctgtgagtttgtggaatgcttcacaaagacagttgatctgagccatcagcaagaagtcaagttgaaggacaaggacagcagtacaaaatgtggattatgtcacaatctggcatagttggatctgtgagtttaaaatgaaatagttactgctgagataccatttcttctctttgcaaggatacacatattcaacatacacaagagaggaatgtaaagaagtgcctaggcctcctgttttattgttttgttttgttattaatcttcattttcttttggaatctgcctaagagttatggcaactgatgatgagaaactaagactaccaatgttaagtaagttcagcatttcaattaagtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47738 - DNA, 1194 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagcaaaaaaatggaaggatagagagtggaaggaaggaacaaagatgagagaccaagaagagaggggg

SEQ ID NO: 47739 - DNA, 2218 bp, Homo sapiens
atcccagcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggtgggtctgtctccttccgaggactgcgatgctcatacacgcacatcattaagagctctgcgtttgggaacaggcatagcagagattataatttcaagtattgaaatgatttcaaaactgcttttttcaaaattggtattaagttccttaaccacagatcttttgctctcgatgtgagccagtggtaaaattaaattaaaatgtggggtatttttgccctcccttttattctttctaatggacatggaaatgaacatcaaactgggagaaagaaccatttaacatttaattaatttaaaatagtgtattgagcaccggtatgtgctctggccataaaagaattcacagtccaaaactaggagcaaggcagcaaacatcatcttctccagtgtgatgatatataacagaggtttgtacaaagcgctgtcaaaatacagggaaataactgcctgtgagtttgtggaatgcttcacaaagacagttgatctgagccatcagcaagaagtcaagttgaaggacaaggacagcagtacaaaatgtggattatgtcacaatctggcatagttggatctgtgagtttaaaatgaaatagttactgctgagataccatttcttctctttgcaaggatacacatattcaacatacacaagagaggaatgtaaagaagtgcctaggcctcctgttttattgttttgttttgttattaatcttcattttcttttggaatctgcctaagagttatggcaactgatgatgagaaactaagactaccaatgttaagtaagttcagcatttcaattaagtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccagcgactggacttactcaggagattggaaaatatgcttatcaaactctttggaacaaggaactagcctgtgactcagtgaaccaatcacagaagaaaacttgaggaggactgagaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcata

SEQ ID NO: 47740 - DNA, 474 bp, Homo sapiens
cctgtcattcttcaagaaggaaactcactgggaaataccttacacttctatagttgaggagacctgcgatttggaaggaaaggaggaggttcagtgaagagtgggatggctacatttgatacagagcccaagacttgtgttcaagtcccctctgctgcagggtctcactctgctgcagggtccagcccaggctggaatgcagtggtgcgatcgtggctcactgcagcctcgacatcctgggcttaggtgattctcccacctctgccttctgagtagctgggattacaggcatatgccgccatgcctggctgattttttctttttctttttttggtagagacaggatctggccctattacccgggctggtctcgaactcctgggcttaaaggatctgcctgtttcgacctcccaaagtgctgggattacaggcaggaaccactgtgtccagctcctcccgatttctgggggaaaa

SEQ ID NO: 47741 - DNA, 1335 bp, Homo sapiens
gttccctatctgtcctcctccctccctgggaaacaggtgtgtctgaactggggctggaagcagagcctgagagctggatgactggccttgggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaattttttttttctttgagatagggtctttgttgccaggctggaagtgcagtgtgtgattatggctcactgcaactttgaactcctgggctcaagtgatcttcctgcatcagcctcttgagtagctgggaccacagacatgtgccaccatgtctgagtaatgtttaaattttctgta

SEQ ID NO: 47742 - DNA, 960 bp, Homo sapiens
  misc_feature (907)..(907): n is a, c, g, or t
gttccctatctgtcctcctccctccctgggaaacaggtgtgtctgaactggggctggaagcagagcctgagagctggatgactggccttgggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggtaaacccgaagtgaggggacaagaacggggaatcccagtttaattagngtgaagtggggttagaacttggtggttaatgggggttaataaaaacaggggcg

SEQ ID NO: 47743 - DNA, 2363 bp, Homo sapiens
gttccctatctgtcctcctccctccctgggaaacaggtgtgtctgaactggggctggaagcagagcctgagagctggatgactggccttgggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagagtgagttcagtctttctggtagaggcgctgccaagaaagcttacaacctccttgcactgcagctgaattgcctgagtgtccaacaggggataatttcctgccattgataaaatggccaaagctctggcagcctgtcagataattttttctgtgatcctaaatttctctctttgtttaggcagatcattatttatttaactgtagttgcattgtgaattatttgtattatgttgttccagatcattttctcatagtggctttgatttggctctgccttggtgtttgagcccaaagttgaatctttttctctttgttttcttgaagtgcaggatataatctgaaattccatttgttgagtctcttacatcaccatgtgtgtgatgtggaatgaagagatgtgaaagatggattcatgagaccaagcgtgggtgataatgaactctgaaaacattttataaaacaattatccccattcttgttctctgttagcactttgtttgcaaaatacttcttaattatttgttagcgatacatgtcagctgaggtcctttttatgcccctggtctagatggtggtgatggattaaatgggtttctgtaggtcccagagattttaaggctaatgataattaagtattgttattgggccaggcagtgttctaggatatttaccgtttttacactgatttgtccctcccaacaaccttctgggatgggttactattaccgtattcattttacaaatgaaattgggattcaggatggttaaataacttatccaaggttacttagccagaagttgtcaagtccagatttgaacccatgctgtctggctccagagtccatgattctagtcattgcgctatactgtactgtgtagtttctgaattacatatggtcatttggtgcccaagcttgcaccatatcctaaggagttttaatttgtactttgtttggtgtctccctgtaatgatataaatggcactgaaacatatataggctggggacagttaatttcaggttccactggaataggaactgttgattagactgtggaccctgcgaagacatgagctcagctcagtgacagtggagtgtccagatccagtcagtgcttttggcttttttgagtttcactctgtgtgaccttttagatgcttgtaaagtttgcttattgtgggtttttggttttttaaaattatctatttttttttttttgctatgaacctcatttaacctgtcttttagtgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgta

SEQ ID NO: 47744 - DNA, 1116 bp, Homo sapiens
gttccctatctgtcctcctccctccctgggaaacaggtgtgtctgaactggggctggaagcagagcctgagagctggatgactggccttgggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccaggggaagcaacagaacaagcatgtgttcttttttgacaccaaaaaggaagttgaacagtttgatgtcgcaactcacctgcaaacagccccggagctagtcgacagagtctttaataggcccaggatagagaccttgcagaaagaaaaagtgaaaggagttaccaatcagactggacttaagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgta

SEQ ID NO: 47745 - DNA, 522 bp, Homo sapiens
gttccctatctgtcctcctccctccctgggaaacaggtgtgtctgaactggggctggaagcagagcctgagagctggatgactggccttgggcctatttccggtaggaatcagtggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattacaaacttcgtgcagatgactaccgtaaaaaacaagaatacctcaaagctcttcggaagaaggctcttgaaaaaaatccagatgaattctactacaaaatgactcgggttaaactccaggatggagtacataattattaaagggggggagggggaaaaaaccccccctttttatacaaaaaaacggcggggggcgcccatcaggacgcccaatatattagaaaggaagaggcg

SEQ ID NO: 47746 - DNA, 244 bp, Homo sapiens
tctccctcctgtcgctagagcccttcccttcctttccatacatgtcctagtccatcctcactttctcactccttggcaatagcttactttcctgatttttctttgctgactttacctgatcaaatctgttcatccactagaacaatcattctaaaacacaagtctggtttattgtttttgtttttgttgttgttgtttgtttttcttttctttccaccctcaggtcccatacttcacagcactc

SEQ ID NO: 47747 - DNA, 422 bp, Homo sapiens
aatgattattgggaccataaatatgtctaaaaataagcctcccttctaaaactttgcaattgcttatggcagtggttctcaagcttcggtctgtatcagaatcacctggcaagcttcttaaaacacaaactgtaggagcctacccacaatttctgattcagtgggtctggggtattgattgagaactggcctgtagaacaagttcccagttgatgctgatgcttgtctgggaatcacactttaagaactgctgccttaaggcattatacctctagactagttaaaacatcatcttgactaaaaagtttatgataaagttttggcatcctaccccaaaacacaaagaatcacagaaatgatataacccaatgttatcaaagctttgaaaaagcaagtgccctcaactgtacttgatagtattt

SEQ ID NO: 47748 - DNA, 355 bp, Homo sapiens
caatagttccaacaacccacaaaagtattttccaatcattataatgacctctctactctctctaaggcatagtgctaggtaatgaagtggactctgcctatcaagatggtcagaccctgagcgaagagggagtgggaaggcctgaggtgtcttcaggctgcctggggaccggggacccaggccagacagacagcagctccagggctgcggaaaggcccagccctgcacacacagcgctggctctgatactcctctgaggagcctgctgcctctgaccacaccttgtgtgtgtggttcaggaatacccaagttcatctgccaaattcaggatacaaccctgactgttccgggcttt

SEQ ID NO: 47749 - DNA, 675 bp, Homo sapiens
aaacaggtcaggtaaacccacatgcccaaagtcacacacaaggcagcattctgaagttcagtcgtttcattttgcctaaatgaatatgagagatatcttccatttttccatcccaattccctatccgcctgtctgagcctcaggaaactagcctcatgacttcctccacacacttccctgccctctggtttctgagtgggacgtggagagagggaggagatggaagttggggtctttattcccacagcaccccacccctacccccgcagacttaactaaggctggcagtggccttcaaccaaaggccatagtgtctggtgtacacagccctcttgttccaagtcccggtaaccactgcctccccttgtcctagcccctccgtcttacgctaaccattgtaatttttctacatcctgcccacaccattataaataagttaatgatttattgtgtcgtcttcaaattactgaagtggggagtgtgccttctgtttcctgttgtgacgctgcagataatagcaagtaagttaaacagtaagtaaatatttcctatttcagaggaatataaaacatcacacttagtgcttgcttcagcagcatatatactaaaattggaacgatacagagaagattagcatgacccctgcgcaaggatggcacgcaaatttgtgaagca

SEQ ID NO: 47750 - DNA, 161 bp, Homo sapiens
aagaaattcaaatgtcagtgtccttaaataaagctttactgacacacagccatactcatttgtttatgttttatctgtggctgatttccagctaccacagcagagttgtatatagttgaaacggagattgtatggcctctaaaatctaaaatatttgctaa

SEQ ID NO: 47751 - DNA, 2519 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaaaaaaaaaacaaaacaagaaaaaaaaaaaaaaaaaaaaaacaacagggaaaaaagacaaaaagaagatgaagaaaaaaaacacagagggaacgaggggcgcaagaggaagagagcgggggatgcacgggaagggaccagaacagaaggtgagacgggagcacgacggcagcatgggagacgaaaagggaggggcagagcaaaggggggcgcgggggggtcgcgggagaggggagcggg

SEQ ID NO: 47752 - DNA, 2174 bp, Homo sapiens
  misc_feature (2150)..(2150): n is a, c, g, or t
  misc_feature (2168)..(2168): n is a, c, g, or t
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgttacctgnccccgggcggccgctccnaaaagg

SEQ ID NO: 47753 - DNA, 2000 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggtaattttatgccaagcactttttaaaaagt

SEQ ID NO: 47754 - DNA, 2327 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataataagtccattcaaaaaaaaaaaaaaaaaaaaaaatgttgggcggcgggcccgaaaagcttcaacccctgtgggggggggccctggttcttgaatgtgaaggtccaagaccgctcgcaaggtgttcccaaaaacccgggacgcttgaacccgcgcggcttcggcacggccgcgtacccgggg

SEQ ID NO: 47755 - DNA, 1679 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtatttaatctctacacagagagtaatatgtttgccacacgtcatgtcagactttgtctacagatgtctgttgggaggcgaa

SEQ ID NO: 47756 - DNA, 548 bp, Homo sapiens
cttgagttcagcctgggtaacatagcaagacgcagtttcttaaaaaataataaaataataagagagtgaaagagagtgacagcgttctctgatagtccattttcagctttggtttggtatttttaataagatgattgctaacagccttttgtgttgtgtcacatgcctgcataggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaccctttttttcttttttcttttttttttttttctgagactgagccctgctctgttgcccagg

SEQ ID NO: 47757 - DNA, 2343 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaccctttttttcttttttcttttttttttttttctgagactgagccctgctctgttgcccagg

SEQ ID NO: 47758 - DNA, 2226 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaccctttttttcttttttcttttttttttttttctgagactgagccctgctctgttgcccagg

SEQ ID NO: 47759 - DNA, 2289 bp, Homo sapiens
ggcacgaggctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaagttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaccctttttttcttttttcttttttttttttttctgagactgagccctgctctgttgcccagg

SEQ ID NO: 47760 - DNA, 1917 bp, Homo sapiens
gactgcatccacgcccgctgactgcatccaacgccgctgactgcatccaacgccgcctgactgcatccaacgccgcctgactgcatccaacgccgcccgactgcatccaacgccgcctgactgatccaacgccgcctgactgcatccaacgccgcctgactgcatccaacgccgcctgactgcatccaacgccgcctgactgcatccaacgccgcctgactgccaacgccgcctgactgcatccaacgccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaccctttttttcttttttcttttttttttttttctgagactgagccctgctctgttgcccagg

SEQ ID NO: 47761 - DNA, 1391 bp, Homo sapiens
caccgggctgtacccgagccgccgagccactgcctcccctccggatcctccccggaggctctgcggcccggaattccggggatgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47762 - DNA, 1399 bp, Homo sapiens
  misc_feature (955)..(955): n is a, c, g, or t
caccgggctgtacccgagccgccgagccactgcctcccctccggatcctccccggaggctctgcggcccggaattccggggatgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggcgtgctccccacgctcccganaggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47763 - DNA, 676 bp, Homo sapiens
cggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47764 - DNA, 414 bp, Homo sapiens
ccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcgggggggggctgtgcctgcaggagacgccccgcccccctgcagctggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctct

SEQ ID NO: 47765 - DNA, 1324 bp, Homo sapiens
caccgggctgtacccgagccgccgagccactgcctcccctccggatcctccccggaggctctgcggcccggaattccggggatgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47766 - DNA, 1447 bp, Homo sapiens
caccgggctgtacccgagccgccgagccactgcctcccctccggatcctccccggaggctctgcggcccggaattccggggatgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctcctcctggaggcctctcctctgcagcacagtgggctgccgcggtcgggctttggggcagacggcaggagggaccttccggggtggtggctgccactggagtctagcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47767 - DNA, 1207 bp, Homo sapiens
caccgggctgtacccgagccgccgagccactgcctcccctccggatcctccccggaggctctgcggcccggaattccggggatgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 47768 - DNA, 543 bp, Homo sapiens
agccgtgatttgtactttcagcccaaatgccctggaaaaggctgtgtggagctgattcttctggagtgcccagcctatgaacttggaatattcaaaagaatcaggtgactctgatctcctgccaatctgaataggttacttaacagctgaaagttcttgatggtactgttacttctgaccagaagattcaagtaccaaacccaggtcgatccgactgcagaacgcttgccctgcatttctaccctgcacagctttccagatgggtttgtccactagcaggcaagaatggcccagctcagcaacagagaaggaagatttctcagccagccaaattaactcagtaaataaatactggccaatatttaccaggaaccctgagatttctacctacataagcacaaaatgtagttgaggttcctgggcactaggcatgtttagatatgagatatgccttcatgttctgtttgtttttttaaatgtctttttatgtgctgctgatctatattaaaatatagtaaaaaatatactaataaaataaaatgt

SEQ ID NO: 47769 - DNA, 819 bp, Homo sapiens
ttgaggagctcctccaggaggggctcaagcccgtcctggaggaatgtgataattaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttccaaaaggc

SEQ ID NO: 47770 - DNA, 937 bp, Homo sapiens
ctgtgtttgtgatttaacattgtagggccaactaaattcccaaactagcactgacatctggtgcttaccgaggttcataccagatgtcagtgctagtttgggacttagttagtgctgtgtttgtgatttaacattgtagggccaacgttttcctctatggttaccttgttttggtaataattgtttaaaaatatgtgtaacatttcatggagcaggttggatggcaggattttgtggttggaaatatggaaacttctgccgatttggaggtgtaggaggttgactattggatgtctttaggaagcatagcctttactttggctgttttggtaacccctgacccttctatcgcaatgggacttctatgctggtgggaattccacactttctgccctagacaattagggtctgccatgagtcccccactctgctgagggtgtgttctaaaaatgaactaatattattagtcattattgatattcaaatccaatttgtccaaatagatcattagcactctgagacctgggttccctcctagctcctgtgacatcttatcagagtgattaaatagcagatggctcagtaaatatttgttggtggcaaatacatacttggcaacctcccagtgactttaccctggacagtaaaataattgcttgaatgcataacccaactttgaggtgagcctgcaggagctgctgaggcacacctgtgtgttgggctctcaaggcagccagaggtgagtcggcagctgagatcacgctccagggattcctgcgtcctttaataagattctggggtgggcacagttctggggtggacatggtggctcacgcccataatcccagaactttggaaggctgaggtgggaggatcgcttgagcttaggagttcaagaccagtctgtacaacacagtgagagcttgtctctaccaaa

SEQ ID NO: 47771 - DNA, 1803 bp, Homo sapiens
agcgggcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggtaaactaatatttactttcattgtgattctcaacaatccaacctagccaaagaacttctccacttaaaaataaaacctaacactgtttatatttttatagattatcagggaggtttataaggcctaattgtcaccttgaataaaattaatacctctacaatcagtgcatctggttggcatctttgtctcatgtgaatttataaagaacatattcttctcccagattccatgaatgggaagatttgcattgctggcagctgtaaggttctacttttctcccctaaaggagaattcaagagaaagtacaatgagaccttttcttccttccctttctggggaagatgctagtgccatcttgcatatgaaaaaacaattgtaatagtttttcataatttctttaatatagtcttatagctttgatttgtaagaggtatataaaggctatcaatataggaagagaatgtgaggtataatgtagattcaacagaacgaaaataaaaggtat

SEQ ID NO: 47772 - DNA, 538 bp, Homo sapiens
cagaaggagccaacagagtgagatgaaggggacaacttcagatactcaggcagaagcataagtccccacctgctgacctgctgcctgctatcttaacacgaattcttcatctgaatggatgagcttttcacagtgtctatgtgaattcacgccaagtcatgtgacagtttgcataatgaagtgtcagcagatgtgatggaaacagaagtaaataaaatatttgcacgttgctgcttgctcccttttacctcagcctttaccagggagaacaaacccagctaacctgctagaggatgacagacacgtcaaccagagctggtgtcccagtcacccaagccaaggccattctacctaagcccacagctaattcacctccagaaatgtgagcaagcctagccaagatcagccaagccaagctcagagagacaatttagcacaaactatcaaaagctttaaaagatgtctttatctatagttagaattacacatttaagaatctaccttattgggaaaaatacagtcaaagattttatagaaa

SEQ ID NO: 47773 - DNA, 1340 bp, Homo sapiens
agcgggcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagcataagtccccacctgctgacctgctgcctgctatcttaacacgaattcttcatctgaatggatgagcttttcacagagttccaaactaaggaatccaggagtggccaatccagagattcattccttatctttgacgaacatctgaactcctggctcatcctgtggaattcaggccatacaggagatcaaggtcatttgctttgggttaaatgaatgttgccaggtggaggttgctagagggagagtgctatgtgaaagtgctgtataaactgcttgcttttcacaaacagtagtgattctttatcctgtccagcctgccacaactggaccatcctgtatgtaagtccccttaataaatcctgtgtctcattcactggct

SEQ ID NO: 47774 - DNA, 1052 bp, Homo sapiens
agcgggcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagcaagaaggccctcaccaaatgccagcaccttgattttggacttctcagcctccagaactgtgagaaaataaacttctgttctttataaatta

SEQ ID NO: 47775 - DNA, 434 bp, Homo sapiens
gtgacaggtgaccgcacacatgtgggtgccagcgagggtccgaggaggctggcgatgccttcgtccttggtcaggtcacgagcacctgtgaatccacagcagaacagctgttcacagcttcccctttcatcccggagtgagtttcaaaacctgcaccacgactgcctctgtgtattttctccgtcctctagaagatcctaggctccgtgcagcaatgggtgaaggccccttacacaaaaacaaagtcaggtcctgagttcttttgctgtttctttgctttctcctgcaaagtcactcgaaaggtgactggcggaggtgaggctgcgataattagcttgattgtggtgacccttccacaaagcacgtgtatgtcggcatattcactgggtcatgcacctcgaatacatatttttacttgtcaaatacatgataat

SEQ ID NO: 47776 - DNA, 204 bp, Homo sapiens
gtagaattaatggataaaaatgtatgactgtttttcaggcttttaatatgcattgccatatttctttccaaaaagggtgcagtcttcagacatacagactgtgcaggggtttccaacagtaggcaagctctctctcctctttgtctcaacttttctgacgttatagctaaaatttgatacatacctcgttgctttaatgtgaaa

SEQ ID NO: 47777 - DNA, 385 bp, Homo sapiens
cctctccatatctttgctaccacttgttattacatgtcttcttgattttagccattttagtggatgggcggtagtatctcactgtggtttcaatttgaatttgcctgttgtctcatccgtgaaagggccctagtgtggaacctcaggagaatggaaactccccctgctgtgtttaatcttatatccctagggcctagaatagtgcccagtgtacaataggctcccaataaatacttgttgattgattaaatattcaatacttccattatttaatccctagaattaagttagcttcttataggttagttataaggtgttctgaaaccatataagtgaacttttcatactatctcacattaaaatctgttgacctatcttaaaaaaa

SEQ ID NO: 47778 - DNA, 484 bp, Homo sapiens
gaagactctaagagaaaaaagacagatgtcttctggaggacaaggtattgggccagcagattacttttggactggagctacaacatgacttcttccctgggtctcccaacttctggccgacctggcagatttgtgacttgccagactccaaaattacataaggcaattccttaaaataaatctctctctctctctctctctctctccctctccccctccctccctctccctccctctcccgctccgtctccctctctctctctttctatctaatccatacctaatattctatttgttatgtttctctgtataaccctgattaacacagtttgtgaatatgccactgtaactgaatttttaattttttttttcttctccaaatgtatatatatgtatactcaatctttataatttcgggtgcttttcacccagtttttttgatagcattttggcctttctttttaatcaccataaatgtttttca

SEQ ID NO: 47779 - DNA, 725 bp, Homo sapiens
aaatgttttatagaaatagggtctcactgttttgccagggctggtctcgaactcctgggctcaagcagtcctcaccttgacctcccaaagtgctgggattataggcatgagcttactcatagttttaaaagtcaaattgtctttcatctgtttcctgtctgcacaaaatagccttctcttccattaatctgcatattcccttaggctttatttgtttttgagacagggtttcactctatcatccagggctggaatatagtgatgtgatcacagcttgcgcagccttcacctcttggggctcaaggggatcatcctacctccatttcctggagtaggctggggactattagtcacgaggccaccatggcctggctaattttttaaattttttggtagagatgaggggtctcactatggttgccccaggctgttctcaaactccctaggctcaaacagtcctcctgcctcagcctccccaaagtgctgggattacaggcatgaagatcttgcttgcattttaactcacaattcatgtagttatataacttcattttgaaatagtttcaaacttaaagaaaaattgtgagaaatagcacaaggaacttcttcctgtaaccaggggtgtccaatcttttggcttccccaggccacattggaaaaagattgtcatgggccacacgtaaaatacactaatgctaaggatagctgatgagctaaaaaaaaaa

SEQ ID NO: 47780 - DNA, 466 bp, Homo sapiens
tgtgctgttcccttaaatgtggtactaaaattatagatggcaatactaatgcctttgtcatagaagccttagaatcccagccaggcctgtgtgagtatgctcagacagttgcaaagtgatttcactcctctcaccttggggtcaacacctacccccactacacccctggtcagcaggaagaatttagaggggtcttcgcccttttcccatcttcattagctaacaccttaagattaaggtgttataaaatccaaagggagagattgaaaccaccattgcaaaattgtaactgagacagtgaaaagagatctgacctaaccaattccatcttgcttctaacctccaagctgttcttgttcattcctgggcataggctgaactaactttgggaagaacttaatttatagttcatagcttaaaacaaaggtgataacaggccttttccaaggcaaacccccttcatgcc

SEQ ID NO: 47781 - DNA, 396 bp, Homo sapiens
ttcctttgttaaaaggccaacaaccccctaagtgagatgttcttggaaagaccccttgacacttgaaaggtgagaaatccatttaaaccatgtgatgccttccactgctctactgctgggttctgcttgttttaatattagtgatagatgctctggctggtgtattcagtaattggaagtgaactatataatataaatgacatttcatggcatatgtgagggcacagtggatgacacttgatttcagtgttgcctgcctttaggtttaaagttagaaaccataatggaatttaattatcagcatatattcaaagattagttcaatgcgtttgtaatacccttagttgttaggtaactgtttgattattgggcatgatgctgagtgtgtgtgattta

SEQ ID NO: 47782 - DNA, 600 bp, Homo sapiens
ggacaaaaagtaagaccccatctctacaaaaaaatttttttaattagccaagcgtggtgatgtgtacctgtagtcccagctacttggtaggctgaggtgggaggaaggcctgagcctaggaggttgaactgcagtgagctgtgattgcaccaccacattccagcctgggcaacagagtgggacccttctcaaaaaaaaaaaaagaaagaaagaaagaaaagaaaagtactataactattaaagaaattcacttacttgtaagaacggctgaaataaaaaatagcccccaaatgctgctaaggatgaagaaaagacaaatcactcatacattgctggtggaaagtaaaatgggacagccactctgacagtttggcaatttctttaaaagctaaacatgtgactaccatacaacccagcaattgcacccctgggcatttatctcagacaaatgaagacttacattcacacaaaaatctgtacatgaatatttatagcagctttatttgtaataccaaaaactggaagcaatccagatatacttcaatgagtgaatagtttaaaaattgagtacatctatattgtggaatattactcaacaat

SEQ ID NO: 47783 - DNA, 1053 bp, Homo sapiens
tctaccctaatgagctcatcttaacctgattacaactgcaaagactatttccaaataaagtcacattcacaggtattgggagttaggacttatcctaatatcttttggatcttatgatatccagttcagcccacaattaaacccacaatgctcttcgtgagaaagaagcagcagccatgaagaaagcctagatatttttaagggtggagagcgctcttgacctttcctttgacagccttgagcttccctaaatactgttgtcctcactgactggcttgtcttaggagtagggtttttgatcttcaaaccttggagtgcagttcagtaaagtgagacaagcataccttctgtctctgaggtccaggagcactggaagagtggacagattaattgtgaatagagaatgccctgaaaatacaggaagaaccaccctcctgcagatgtagctctggtcccttgtgggagcccctggaccttcggtgaggcagatctggaaggctacagcaggggatgtaaagagccccttcctagacccgcttcctggcccattattctgcccttccaaatgtattccaagggctcctcattttgatcattgctcagtggcattgttgtagaggaagtaggagggtgcttggtggagtttgggaggcccatgaatttctgcacttggagaaatgttaatgttgagcttatatttctctccttgcagcacagaagaccattactaggtctgtgtgtagaagcccaagcagttagaggggctctgcgaggcttgtgggatttttctggccagaagatgggccatggtggaggaaggccatgttaaatggctgtgatccactgcctatagggaagagtacgcaacacacacccaggagggcttaggtagccggaactgtggcggctccatacccccaaagtgaattttaaacttgacttatttatgccgttctcatagcaacaggaaaactgttccgacctatagccacggaagactctgtaaaagaaactgtaggaggaaaaaaagataatgccaggaaaaaaaaaaat

SEQ ID NO: 47784 - DNA, 446 bp, Homo sapiens
  misc_feature (444)..(444): n is a, c, g, or t
ggaggaaatcttcatgaccttggattagataatacagcaccaaaagcacaaaaaaacaaaagaaaaaatagataacttgaacttcatcaaaactaaaaagcttcatcatcaagaagtgaaaagacagctcacacaatgggaaaaaatagccaaatccatgtaagcagaaagtagatttgtggtttccagagtccagcttgaagtggggatggggagtggctgctaataggtattgggcctctttttggaggagtgatgaaaatattttaaaattagataaagtgatgtttgcacactttgtatgttcacagagtactaaaacccattgaactatatacttaaaagagtaaattttatggtgtgtgaattgtgaagctaattttttatacttacatatctaattcagtaatgctagaaaaatgacatatacacatgcaaaaaaanaa

SEQ ID NO: 47785 - DNA, 628 bp, Homo sapiens
caagagatctctttttttttttttttttttgagacggagtcttgctgtgtcgcccaggctggagtgcgctggcgtgatctcggctcactgcatcctctgcctcccgggttcacaccattctcctgcctcagcctcccaagtagctgggactacaggcgcctgccaccatgcctggctaattttttttttttttttttttagtagagatggggtttcaccgtgttagccaggatggtctcgatatcctgacctcgtgatctgcccgcctcggcctcccaagaggtcacttttgactgcaacatgcaatttcctggagagatgaattagctgctcacaccgagatgattagcgtcacagggtgtctgaagcagattgaagcagacactccccacgctggaggcggctgtgaaattattccagcagtacagtctgtttgttccacaattaatgttacgcagttgggatttcatgctcatcttcacgtttgtttacatttctctcaactgcaagtggtgccatgtattttgtgtgtgtgtgtgtgtgtgtgtgtaaggtttgatacattttaactttttaaaatagatttgtgtatattttgtgtatgtaaataatagactagtatgtaaat

SEQ ID NO: 47786 - DNA, 286 bp, Homo sapiens
caggatagtcctcagcaagattccgtgtcattgtgttcacaagcacactagaattgtaacaagtctcagatttgggttaaggagagatgataactgtgtctgtaggatttgcccttcctctgtcttcacaccccattcactctgagacaaaggaggtacttccagggctgctggaccagcagggatgggacctcgcctctgccctgtcttggggtcagcctgcccagcgagtaccctctgctggctccttctggcatcttactgggtcctgccgtgcagggacaag

SEQ ID NO: 47787 - DNA, 747 bp, Homo sapiens
atttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgttttttttttaaaataacatggttaagttttatatatatttacgtttgtttcaggaatgtctacttgtgactttttatcaattaaaaataatatttggaagaaagag

SEQ ID NO: 47788 - DNA, 512 bp, Homo sapiens
aatttggggagagacatggagacaggggcttttaagtacaaccatgctctgccactcccttactactcaattaccctgggtttggtgattgcctattttactcaggtaaaatactggtcctgcagcagggaaaccaaacttggccctaaggtaagcatcacttggccatgctgtaagcagagctcagctctttggtatcctttctgccagctcacagtttaataacagatgccatgaggcatgtggcattttctcagcgaagtcggcttctttctcttttctacatgtatcacttattcatttgacaactatgttttgagtacccactatatgtcaggtgatgttcaagatgctgtagattgaacagtgaaaaagaaaataagattctggagagtacttgccctatctttctagagctccccagtttgggtctgggaatgtgggaagaggaaactccagcacacatctgcccaatgcctgactgggcccctctctctacagacacctttgct

SEQ ID NO: 47789 - DNA, 865 bp, Homo sapiens
aatcaaacaagtctccaggaaaatctggtccatgggctaccaatttgagaccattggtctggtagatacactttcattaatatacttactccatcactctttctatattttagaagttactagtagaaatgtatgcaggagtcactggagaccttattaaaatgcagcttctgattcagtgagctggggtggggcctgagagtctgcatttctcccaggctccctggtgctgccagtggtgctgctctgagtaacaagggggtggggaatgatatggagccgtccattattatcccatctgacaaatgagtcacagagcccttaggtaattgaggtgggatcagtctgattctgtaagctgtgttttcagccacaacatttactgcaaacttggagtaggtaattatgaagttcctttaacttgctgtggaggttgaatgagctctagagtaaggggtccgcaaccccggtaccggtccatggcctgttcggaaccaggccacgcagcaggagttgaaaggtgggtgagctagcgaagcttcatctgtatgtacagccactccccactgctcacattaccacctgagctctgccttctgtcagatcagtggtggcattaagatgctcgtaggaatgcaaaccctattgtgaactgcgcatgcaagggatctaggttgcatgctccttatgagaatctaatgcctgatgatctgtcactgtctcccgtcacgccttgatgggactgtctagttgctggaaaacaaactcagggctcccactgattctacattatggtgtgttgtacaattatttcattatatattacaaggtaataataatagaaataaaatccacagtaaatgca

SEQ ID NO: 47790 - DNA, 810 bp, Homo sapiens
tcccctttatgttgtcacagattatgtctttatacattgtgtgcccataatgtaaatttatatttagttcttatccatttgtcttttaagtcctgcaggaagtaaaaaaatggagttacaaagcaaacataatgaccctggcttttatatttgtctatatagttaactttattggaagtctttattttttcctccagatttgagtctagtttctttttatttcatcttgaaagacaccttttagtgttccctgtatagcaggcctagtagtaacaaactcagcatttgtttatctgggattatcttcatttctctttcattttgaaggacagttttaccagctagagaattctcagatgatagtgtttttctttcaggaatttatatatgtcatccatctgtcttcaggccttcaattgatttctgcggagatatgagctcctgatattaatgagggtctcttgtaaagtaaaaatgccacaaaactttcccaccatttgaagtcgcctttttcctgatttagcattcacttggttactgtaaacctttaattattttccagagttctaacaaggttggtttttatagttctttttttttttttggtgtttctgtgtggggacagttgggagctgtgtactccaccatttgattatgtcactcaacactgttaagtgaatggaccagttgtccattcgagaacaacaacaaaatgagatatgcaaagaaacaggaaaaatgtgacccatgcacaggactatcaataggcaacacaataataactgccattttagttggcagaaactgggt

SEQ ID NO: 47791 - DNA, 582 bp, Homo sapiens
gaacctgcgggtggcgggggaggctcaagggtcatctggccgaagcttcccccttcacaggtgggaaagcctagacatctttagtcctttgtttggagctttaagtctgagggtgtctgtgtgagcagagggacagataggatggctggagggaccccagggttgggattggcacagaccaggctgggaaggtgaactcagagctgagacaacacaaggaaatgccagcccagagccttgtgggaggcctggggtggtcccggtaaacggggccttgggtctgcaagccacgtatcatgactccaacagccagctttcctggcctgataacaaattgcctaggacctgccactggctctcgcctccctccacctcactctggcagctccctctgccccatgcatggctttgctttggccagagccctggaaccaaagccctttacctggaggggacattgagactattggcgcatcctcctgggaggcccagagagggtaagagccttgcctgaggccacacaggccactggaggtgtgcagagcctggagccccactcttctgagttttgtttttccactt

SEQ ID NO: 47792 - DNA, 441 bp, Homo sapiens
acccagaccctggtgtgtctgggccatgagaataccttcccaccccagctaagccaccgtgtaagtataaatcttatgcgtacccaacttgttgctccaaggctgctttccatggaaataaggcactggacaattccttggaagagcctcagaccaatttatgaggcacacaacccaagcccaagagatgtacactggctcagtttaccttaaatggaagatctcacccagtggcctcttctccttcctagtcaattgaaaaagagcttctctttccctctttaatttgtccttatcttctgaacagctcatgttaccaccataaataacttatggaacaggatgcttttaaaaaaaatgggcgtttaagtcttatcttggctgggcgtggtggctcacacctgtaatcccagcactttgggaggccaaggcaggcagatc

SEQ ID NO: 47793 - DNA, 351 bp, Homo sapiens
agcagtggaaggaggaagaaaaacagagcacaacaatcttagtgagttgatgagatgtagatcaagtttagagagtcaaacagctggaatttttagagtagactcagaatttcagagataaggatatatgtctttttgattcctttgagtctaaatgagagaggaaattacctgaggtcaaggttaagaactacgagaaaacagcagaccaaacaacgcacaatcattataaaaactgagattaggccgggtgtggtggtcccgtctgtaatcccagcaatttgaaaggttgaggcgggcagatcacgaggtcaagagatcgagaccatccgggtcaacatggtgaaactc

SEQ ID NO: 47794 - DNA, 644 bp, Homo sapiens
aatgatataataaattcactatttcatagcctagtggctaagagccttggttctgcaaccagacttccaggcacctaagtgccagtctcggctctaccccactaaccagctgtgtgaccttgggccccagtttcctaatgtgtaaagtggggttaaattatggtagatacttaaaacctttaaatggggtacaggtatgttacctgaaacagtgctttgctcatatcagcatccagcgaatgttagctaccattatgccttcagtaccatgtagttaactgttgctaattactttgaggcacatggcaagattctgaaattgccttctgaatggtgaaagagaattttgtgtggtttttatgggtactgtaagcctagaaagtcaatgaaaatttgggcttcacccttatcccaccactgattctggataattttggataagagtttatttctgttatccattttcagaaaagatgattgtgtagtctcttccttacataaatatcttttgaactggttataatgtgcttgtggagctttttttttttgagacggagttttactcttgtcacccaggagtctgtagaggatgccacggtaatcgtggtgaacacttcctttctgtctcaattcccagtagaagt

SEQ ID NO: 47795 - DNA, 411 bp, Homo sapiens
caaatagtgaaaagtcagtagacagcagaaacttggaatgtattagtaccaaaacgctaaacaaatattaggctattaaaacactaagaattagatgtgttgccttaaaaggtacttagttcctccagcctggtatgtctcagtggccacttgatgctgtagaagaggctcaggtgccaggtgcatgataggggtaggtgggctctaaggtgcccttcagctccattttgctacggttatatgattctttgagatactttgctaaaacataaaggcacaatatatttttgccaaggaggaagataatgttctgaccaagaaataatattcaggggaaaaaaaagaagtgccatgatttcacatatttcaagctttactaaggacaaatggttatatatatatatatatata

SEQ ID NO: 47796 - DNA, 293 bp, Homo sapiens
ttcatgtgaggaaaaaagaaccaaacaaattacaagatgacacaaagaagttaatcaatggattgataaatacactaagtacagttttaaccacacaaaacttatcaatatagggaaataataaatgaacagtaagaaaacctatttcaatatatgcaaaaataaatattttagttctcctagtaactgtggttgacagcaaaaatggtaacggagctgtggaagtggcctaagaataaaaattttagtagttataagtctttaagtaattataaagttataaagtaattaca

SEQ ID NO: 47797 - DNA, 489 bp, Homo sapiens
gaaaattacgaagcccctccctaaaaaactgttaacgaagctaaactcttgttcatccaagtggtttccagacagtcatgtctgggggcttgaaaatggggcttcttccagccctctgattcagtaaccctatgagaacccaactgggcttagcaacgtgtctgccttctctccttaactcaaatttaacaaaatttccaatgtatttgatattctttgccgtgtccttttctcattaattcagaatactagtatgttttaagaagtcagtgctcatgattttaaatgattagaacttaattctccaactgctgtttaagggagattattgtttgaagctcaacaagccagtttcattgggcacgtctccagttactagaagaaggacaccagcattctggttttttttatttccatcatgaatgtttggttgtcttcctacactatttctgtgttcctgtgagtgaccacagttatgaccaaatgcca

SEQ ID NO: 47798 - DNA, 287 bp, Homo sapiens
aggagatctcaattcaaacatgttcagccgccagcaaggttgtataaatgtgaaaatgggatgggatagagagaaagtgactctggtccttcaaatatagggcacatatggtatagagtgccgaggactgtggcaaacaggaagcctgtatccctgagtgcagcagatgcaacctcgttgctgctgcatgaggaatgcggatccagtgttaccaggaatcctcatttttcaagagaagccagaaagctggatttttatgtgaaatggcttgatttttaagaatctat

SEQ ID NO: 47799 - DNA, 806 bp, Homo sapiens
atagggagaattgcttaggacttgatgagccaagacttggaggcgaagaagtggttggagaaaccaccccaggcagaggaaccccaggggtcagccaatgcaaggctctaaattaggaagtactcagtgaggctgagaacaataaggcactaagttcttttaggttctcaggcctttgcacttatctctgcttcaaatgcctccttttcccttcctatctgggaaacattcactctttcttcagtgtagcctccaagttcacttgctcagtgaaggcccctctgattctcccagaaaggatgtgctaccccatcctccgtgctcacaagcctcggcccacagctcaggattagtttttattacagtgtggctttaggttttcatatctgacttccccaccagactatgaacaaatcaaaggcaaagattgcgtttcattgagctgtgcttccccgaacatcaggcatagtgcataagacacactcactccataaacctttgtatgtcaaatgagagatattatgtattaagcagtccaattcctcttttcactgtgcattcttcatgcaaatggcagctgtgtcttaggtgtttcccatatgtagcgacaaggtattatgtactataaggaataaatgggaaattaccaaaccccttctctaagcagaactgagggcagggatttcacatcaaacagaccatgaaataaatggagagggctaatttgtatttatttatgtatttatttatttttatttatttatttattgagagaaagtctcgctctgtcgcccaggctggagtgc

SEQ ID NO: 47800 - DNA, 370 bp, Homo sapiens
ggtctctgctgatgtccctctgcagctgtcctgccagtgaggcactgttgacccatcgtgcctgggcctaactgtcatgtagaaatagtttctggaagtcatctttaaactggtctggtgagtattctaagtgcgaccaacatccccttccttctcctgacctagttggccccttctgtgggttccagatagcctttttctgtgggttcatttgtattgctctagaacaggataaagatattgtctaactttaggctttgctaagttaaatatgaaagttaaattttctggccaggcgccttggctcatgcctgtaatcccagtactttaggaggctgaggtgggcggatcgcttgaggtcaggagtttt

SEQ ID NO: 47801 - DNA, 333 bp, Homo sapiens
ttcactcttacattcttcttctaatatacacatgaaaacatttgttttaccaaaaataagtaagaatgcttaaaaaacttgacaattaaaatctagaattgtctgtctgaatgtttcataagtggtctgttcgttagattgaaatttgtgaaaacaggcctctcactaactcatttgcaaatggtaacaatagggatctagtgagtattttgtaaatatttcttaatgagctatgtgatttatgattatgccttaactgatgttagtgttgggtgccagttatatttataaaaatcttggattttatattagcaaaatttttatatgaagtag

SEQ ID NO: 47802 - DNA, 427 bp, Homo sapiens
gccctggctcctgcacctgcctgtctgcatgttccccctcccacaggggatttgaacgtgcagcagccttgcaaatgagccacaccccgtcacaagtcctgtgaggaagtcagggaactctcctctgttagcccaagtggcgccatcaagtaaacccctgccattttgtacaccctgatcagggaggaaacttccataggggctcaggccatgaaaagcattttgccaagcagatcccaggccacactgcctgactgcaggaaatggctcccttattacatcctgccaggcagctagccacactgccccacctcccctgtccagacctataattgccccagtctgtacgcaggacgggggctcagcactcgctggtgttccccttccacaggtttctctgtccaataaacctatgttgctgtcgagc

SEQ ID NO: 47803 - DNA, 2086 bp, Homo sapiens
ggcggcggcggccaggggggagccggggcggccgttgcggggcgcgctctcgagaggcggcggcggcccagggtgtcccgtcggtctcggcgccgggaagaggcggtggcgctgcccgcggtggcgggggttggcgacggagcgcgttggtgccaggaccggggtccgaggcgcgctctccgcccacagtgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47804 - DNA, 1925 bp, Homo sapiens
  misc_feature (1188)..(1188): n is a, c, g, or t
agtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcctggggatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctcatgacgggaaaggctactccaccttctctgtactcctggaggggagtcttgttcacatgtttaccagcggccaggacaaggaagagaaaaggtattgacattaagaggatggtttgctgaggctgtgaaacttgaacgctattagtcagtggaacctgcctggcttagggaatggctgcagcagaatcgagacgtttccgaggttctcagtcatgtttcatttgggctgctgttcttttttctgtttaaatcaaacttcaggttacgtcatgacttctgcagggctgtccttggttcctactgcagggcgcctgtgtggttgggattccttttctgtttcaagatggagctgggttccacccttggagctttgagaggctttagcagttgctgtcctgtaatacctccgttcccaagaaataccgttcacatttcgcttctttttcacactttgaataggagttaaaatgtgctttctgtagtgtttggaaaatggcaaagatatattgtaatgtgagcccgaactgttgttgataaatgtataactattgctaggtcaagaaattgtgaacaacagtgttttgcttggtccgtagctatattgtgttaaatataaactgagtttactgcccttggatgtgattctttggtttgatttagtaatttgaaaggcattggttgactagactgttttttgcccaaggaaccactttgtaattgttacgctgcttactgaagtaaactggaccatgcagtaggcatacagcatacagccagggngttttggcaatgctgagcccactgttttacaagtgacataaaatggatgtcatatgtacaaagaatctactgagagggaaactggattacaggagagctcccttatagtcctttgtcaggggacagaatacctgggtcacactgggcttcagattgagagttgattcatgttctgagtccatatgatgagacacattacgatggaattgtcacttttgttgcctctggaactttaaaatacccgtttagtgacgtggaattaatctttattttttccgtcaccctcagccctcatttaagctatcagttggtaaccacttgggtaatctaaacctaagttgcatttatttggtcacattggtaaccaacattgcttcttaaaagttccttgcaacagaatgactataattgagataaaacattaattttgaggctttaattttgtaatatggattagtggccgggcgcagtggctcatgcctgtaatcccagcactttgggaggccgaggcgggtggatcacgaggtcaggagttcgagaccagccatggtgaaaccccgtctctactaaaaatacaaaaattagtcgggcatggtggcgggcccctgtaatcccagctacttgggaggctgaggcaggagaattgcttgaacctgggaggcagaggttgcagtgagccgagatcgcgccattgcactccagcctgggcaacgagcaaaactccatctcaaaaaaaa

SEQ ID NO: 47805 - DNA, 443 bp, Homo sapiens
  misc_feature (2)..(2): n is a, c, g, or t
cnttgtttatggtaaaatattgaacacgtctaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47806 - DNA, 467 bp, Homo sapiens
  misc_feature (10)..(10): n is a, c, g, or t
  misc_feature (21)..(21): n is a, c, g, or t
  misc_feature (31)..(31): n is a, c, g, or t
cacccccccnaaaattttttncccccccccncttaacccccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47807 - DNA, 243 bp, Homo sapiens
tggccggacacgtagccggacacgaaaggaagcattgtaaaataattctgagttttgtgtttgttgtagattgattgtattgttgaaaaagtttgtttttgcgtgggagtgtgtgcctgcgtgggtgtgtgcgtgtccggccacgtggccggacacgtagtggccggacacgtacctagagatggctaaatctagactgaatttctgctacatctcaggtactcctattacgtgtccggccag

SEQ ID NO: 47808 - DNA, 139 bp, Homo sapiens
tcaagcttctaacgatgtacggggacatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47809 - DNA, 2698 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47810 - DNA, 4090 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47811 - DNA, 3892 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47812 - DNA, 4035 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaaaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47813 - DNA, 2011 bp, Homo sapiens
aatcctccaggaagaaggagagcgcttccaagtcatcgtcgcctagaccaattagctcaagtcggtaagccaaattttcagcttgctggcgtgttcctatcagctggacgattgcgaagaactgctggtgaccatcgtatttttccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47814 - DNA, 2897 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaatcttactgtgtctgctttagctctaagtttgataaaatccgaagttattttcctgtttcattccatactttaattatatagcagaaagctgtgtgttgtcatttttaagtgcggtagacttaactctaaatcacagcaaataactggggtatatgggcctctgggattaggtctttccccatgccctgcccctcttgcc

SEQ ID NO: 47815 - DNA, 1708 bp, Homo sapiens
gctggtttgctatccaaatcctggtctatgatattagtgctataggttgtgctcaatctcaattaacatatatatcgccctggtgagataatcgcatctgtcttggatcgtagatcctagcatcgtcggttactagacgtcaataaacgcggatctattcaaacagctgcattccagtcgagccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47816 - DNA, 3268 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgggtgatgatgcagtcctgttttggctttcacttcatgttagtcgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47817 - DNA, 2645 bp, Homo sapiens
tacactttattatcatagatgtaattttcttaggcctttctgaattctgaaaataataacaggtttacagatataaataatggagcaaaaggacacctggttttggggtcacattttgacaggcttgcactgtcatgtcaggatgaggatttagcctcaagagtttgtattgcctagaaatgtgctgacagtgtcattaagtacaaactacagtatttccaaagaaatgaattttcatgacaaagcttttcctaaaattgttttagaagtccttttgctgtaacttttaaaacatctcaatgaccactcaccatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47818 - DNA, 2451 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactgcggtcccagccacccgggaggctgaggcacgagaattgcccgaactggggaggcagaggccgcagcgagccgagaccacgccacgcagtgcagcccgggtaacagagcaagactccatctcaaa

SEQ ID NO: 47819 - DNA, 1950 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaattttttttttcccccagaattggctctttgtttagaaggagcctgtaaataatccgagttgggttgtgtacaatggtggttgtcacacgtc

SEQ ID NO: 47820 - DNA, 1086 bp, Homo sapiens
ggtcgaccccgtcctagaagctgagactgggccctcaatagatgataccagtctgccagcacgctgacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatagtggtgtattatttggccataaaaatttctggtacttgctaccacatggctttttcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47821 - DNA, 2396 bp, Homo sapiens
agtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcctggggatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctcatgacgggaaaggctactccaccttctctgtactcctggaggggagtcttgttcacatgtttaccagcggccaggacaaggaagagaaaagtgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47822 - DNA, 1918 bp, Homo sapiens
  misc_feature (7)..(7): n is a, c, g, or t
  misc_feature (21)..(21): n is a, c, g, or t
cgacagngacgcccaggcccntgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 47823 - DNA, 4036 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctcatgacataatcacctcctaaagcctcacctatcacgttggtggttgcttcaacatacgaatttggtggggggacattcagaccttagcatatgtgatctagtagttctgctcctggatatgtatccctaaaggacctaagaagggacttcaagagagatgtgtacacccatgttcatagcattactcataatacccaagagggggaaacaatcagcagatgagtggataaaccaaatgcggtctatggatatatcccagggaaagtattagtttttgtttgacaaaacaccttgataggtcatggttctgcaaggcagagatgtgaaacaaagaaagctaactgttgcaaataataaaaagttggagttcctttgagctaaagctaaagtggcaaaggaggaagaggttcatccctacccttctgcaccccattattttgaagaaaaagagtggcctgaccctccagatctttcttttctggaggacactgggcgaaaagtagttgccccagtgactgttcgagcagttgatggcttgctaagtaagaatgctaaacacaaaaggacaactcttgtttgatcccactcatatgaagggaaattcagaaagaaagtgaaatagtggttaccagggtctggggtgagggtggaatttggagctctttttcagtgggtacagagtttcagtttgtggtgataaaaaatgcatgtaagccgggtgtggtggctcacgcctgcaatgccagcatcttgggaggccaaggtggccggatccattttaggttgggagtttgtaaacccccctcggccaccatggtttaaacccttttctgtcccatacaaaac

SEQ ID NO: 47824 - DNA, 3067 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaaaaaaaaaaaaaaaaaaaaaaaaccttgttgtggcgccggccttggcgccctatcagaaaaggcttttcataaaccattctcgtgtgggcgcgccggggcgcccatgtagggtagcgggacccgtggcgcacaagcgcggtgtctcccaagggaagaccccgggcgaccagagactcaagtgggctcgggttttcctctcgccccatataaaaaaaaaggccccggggggggaaaccccgagacggtgctcctggaacaaattccccagaatggggagtcccaggagggcactaacagcggcgctcctatcaccaggggggtccccaagcgaaagcccgagataacaatatagcgcggcctccgtgggct

SEQ ID NO: 47825 - DNA, 3227 bp, Homo sapiens
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattttagatttggaaagggaattggcaaaactaacattctttgtagcaaaatgtcccttagtaatagtcaagttgacctcatttcagtagttcataaaggaaaatccaaagccctcagcagtgaattacctggccacatagctgattttggtcactgtgaatgcagaccaatcacctagtactggaagctcacagtggtagacatcactatcacagtactttacggtcatggatttctcgtgaactatttcaggaacaatcacaaagatgacattcttcactgtatttgcatttgtaaccaccaagcaagtaaggatctctgccccagatgcatggtttgaggtaaggttcacagggaccactaaaggggcagagccaagtaaaaacatggatgtctccagtggacagtgtaggatttcttgataagcaaagcacctaaagcttttagttttaatacttgagaagttttaaaaacccatgcataaaacgtggaataccggtaaaatacacatatccctaagtctagtttaaactaaaatttctagagttaataattttcaataaaaaaatccagcttattttgatacaaggggtctttgggtaacatcttaaaaatcaatgctagaaaatgctcaacatcactagtcattagggacatagaatcaaaatacgtcacacccatttggagggctattataaaaaacccagaaaatgagtgctggcaaggatgtggagaaactggaacatttgtgcattgctggaaggaatgtcaaatggtgcagctgcggtggaaaagtttggcagttctcaaaaagttaaacagaattatcctgttgtcttagtcatttgtgttaaccgtaacagaatacctgagactgggtaatttaaaagtacgaatttatttctcatagttgtgaagactgagaagcccacgatcagcgtgctggcagactggtatcatctattgagggcccagtctcagcttctaggacggggcctgttgctgtgtcctcatatggtggaagggaatcgaagggcaaaaaggaggtaattggttcccttgagcccctttataaaggcactaaatccattaatgaggatggagctctttatcgggttctttctccatgggaacgaatgttcaggg

SEQ ID NO: 47826 - DNA, 2518 bp, Homo sapiens
  misc_feature (2100)..(2101): n is a, c, g, or t
gcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagcatatttgcctgttgtctattcagacctttttgatatttccttcctctttcagcatttttgttttttaagtgcagttttcattgtggtatccaccaaatgtttgtaaaacaaacaaaaaaaatgagcattagtgttggaccataaatcatcaaattggataatgactaactgtagtctttttttttttttttttttttctgctggatacaattttcatggcaataggaactgaagtacttcaaataatgtgagcttaaacatgttacttcattgaaacaaccaaaactacttgatgtttacatctaaaatcctggttaaaataaattccaaaatgcttacccannaacgatgaaaaggtcaaacactttccctttggaacttgctgtaataaaagcatttttaacaaacctacaaattttttttgtattttaaaagggcgaatactaatttttatgagcgaactcatattcttattcatatacttttaatgacacgattaccaatacatgcattattttctttaactttatttttacaaaaagcccacaatgtgtatgcagccattaaaaattttacaggaaattacacaggtttgtaggccaatttaaactccaacttctttaaatagccacttttttgactggttttatgaaggcttggtgtgctcaaaatcatgattagcccgaattgcgaacataccctgtttaaaacaaacattttttaaaatttgttccattaaaagcatcccgaaagtttacaaa

SEQ ID NO: 47827 - DNA, 442 bp, Homo sapiens
agggggctatggttgcggatcctgctgacaatgaggacaattatataacatatactgacagcaaagaatattatgaactactttatgctaataattagaggtagtaaggagccaggagcacaccatctctcctctcccttctttgaggcaccttgggtttggggtgtggaggaatacatagtcttcaccagagagggttgtaggaaaatgcagtattttcgagaaagaactacatttcaattaaagcctggaagtggagagtattcttagtaactcagaggtggagaacattctgattaaaagataaagagtttgtaaagagagagtttgtaaactggaatgagacttccacagggcacagttggaaagggtcaggagatatgtcactatggccatcagtgaggacttaatgagggtaagagactaggaggccacaggagga

SEQ ID NO: 47828 - DNA, 293 bp, Homo sapiens
tctcgatctcctgaccttgtgatccgtccgcgtcagtctcccaaagtgctgggattacaggcgtgagccaccacgcctggccacgagtggattttaaaaacatcgtgattactgaaaataagatcagagtgaaatatataacaagatgctatttatggaaatttaaaatgtttgggccgggcgtggtgactcacacctgtaatcccagcactttgggaggctgaggtgggcagatcacttgaggtcgggtgttgaagaccagcctggccaacatggtgaaaccgtctctactt

SEQ ID NO: 47829 - DNA, 577 bp, Homo sapiens
ggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtacaaatctttgtat

SEQ ID NO: 47830 - DNA, 618 bp, Homo sapiens
ggtgaggctggaaagaatgaatggggctgggctgtgaaggcttagggagttctcagccttgtgggctgagcctatgatgtggaaagcttacaggagggcagtgtgagcccctgactgcatggggcaagctgtccggtaaaagtataatgccagctactcatggaatttaaaacttttctagtagccacattaaaacagaaaagaaaacaggtgaaatcgattttaataatagattttatttaacccagtatattcaaaacattatttcaacatataatcagcataaataacttttaatgagctatttggcattctttcttttggtactaagccttcaaaatcttgtgtgtattttataccacagcacagctgattttggaccacagccatattgcagatgttcaacacatggccggtggctgctgcattggctgcacagggttagcaggtctggggtgatgagagttgaaagtgatcttccttgtcttagaccttcccctgagagcctgaaccaggcttctcgcatcaaacctttgaacaaacctgcccaacagctaattggtacctcagggaaaagagaaaacctgggggattttgtcatgcatgggttatatggtg

SEQ ID NO: 47831 - DNA, 119 bp, Homo sapiens
atgaggcaactgaggcacagggacccgcctgaggccatccaggggacgtgtcttactcgagtgggtctctgcactgccaggcctcccctgctggcggctgcaccgagccagctctgcag

SEQ ID NO: 47832 - DNA, 693 bp, Homo sapiens
gaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatgg

SEQ ID NO: 47833 - DNA, 473 bp, Homo sapiens
ggagagtgtcgcatggtctagctgctgagtgaccgctgatcaacagctggcttcaccttgcatcctgactcctgggagatcttcctctcccatctctcttcccttctttctctgtaggcgcagctgtcaggatcaactgaacccctggggatggctgtctttagagaggagctatgtggccttgagaaaagctgggtagatggacggcctgtccttggaaatgggctctctgcaaggacaaagcctaggagactgttcctcagggtgcagagcacaggcttgcctgtttatttaggtgtgaacttggagtcaggacaggagtttaatgaacaggagaaggaattttgttgagtttgtggccttatgctgattctttttgggatgttgagtagcatgaatagagaaatctttgatgagaagaaaaaaaaacagttttagtgaagtaaataaatgcgggttcattttcatttgta

SEQ ID NO: 47834 - DNA, 1136 bp, Homo sapiens
caattcggccagaaaaagaaataaaaatcttctaaattaggaacatgcaaaatgatttctatttgcaggtgacatgattctgtatacagaaaatatcatataactcacagaaaaaaatactgcagctaattaacaaattcagcaaagttatagggaacaagatcaacacccaaaaatcagttgtttccatataccagcaaagaaatttttaaaaaagaaaaaaaaaatagttcagtttgcaacatttagaagagtaaaacacctaggaatatatttaaccaaaaaattgaaagatttatccactgaaaactaaaaaacattgctgagagaaattaaagaaaatctaataaatggaaagacatcccatattcatggattggaaaactttaagatagcaatattccccaaaacaatctacagattcaagtggtctgtttgcagaaataaaaagccaaccttcaaattgatacggaactgtaaggggcctcaaaaagccaaaacaatattgaaaaacaaaagcaaagctgagaggacttacactttccaaattcaaaagttactacaaagctacagtaatcaacaagcatagtgctggcaaaaagacagacatataaaccaatggaatagaattgagagcccataaataaatccaaatatctatggcaaattaatttttgacaggagtaccacgaccattcaatggagaaagaagagtaccttcaacaaatcatactagaacatttgtataatgacatgtaaaaaaaaatgaagtgggactccatataaaataattaactcatatataataattaactcatggatcaaggacctcaatgtaaggggtaagattgcaaaattcttagaagcaaacatagaagtagatctgcatttcctcagatttgacaatggattgttagatttgacaccaaaagcactagtaacaaaatttaaaaatagattagattctgcaaaaatgtaaagcttttttgcattaaaaaacattttcagccaggtgcagtggctcatgcctgtaatcccagaactttgggaggccacagcataaggcttgcttgagcccaggaatttgagaccagcatgggcaatatagtgagaccttgtctctagaaaaaaaaaaa

SEQ ID NO: 47835 - DNA, 182 bp, Homo sapiens
cttttaagatgagaagtttgatactgctgcatcaactcatggtctgccttgaaagtattgctttacacagatatgtatacccacagagttttacagagcaaacttaaactggttcctagcaaaggaaatggtgtttttgttgttgtttctaggctgctatttatgattaaacatttgggaaa

SEQ ID NO: 47836 - DNA, 559 bp, Homo sapiens
ttcaataaaatagtcaaaagttgttgttttctaatctaccaagttcttcctaaagttcaaatgaaaattcagtttaagaatagccagaaaactttctgagaaaataggcaataaggcaggcagagggacaaatacacctgccagtcaatacaggatgaacagtgttagcccactgacttgatctaatattatctgaaagcaaaagtattttccttaacttgtatagtcatataaggtaaaaaatcaatttcctttggctttaaaatatttagtcattaaaaataacctgtgtatttccatgactactttatttaatccaaatacactttcattgacctagaataccaggttaaataagttgtgaagggttcaatttagtgatgaatttttgcctaactgccttatcagttggcctacactattaaaaaaatcactattttcaagaatctgttaaagctgtaatttttttagtggctagctgtattagagacattgactctgtttacttcctttcgattctagacataggatgcccctggaataattgctatgagagatt

SEQ ID NO: 47837 - DNA, 847 bp, Homo sapiens
catcctctttctaaatgggctggggaaggcagtccttaggagagacagttacatgcaagggagtggcgaaggggggtgtcccacagccttcttgaaagagggcacagcagtttgtttaaaatagctgtttttcagggaagaaggaagagttaagaggaagaaagtagagcatgttttgggactgagcttgcatgagaagacgggtgccctaaggtgctttcctgtggggtagtagctgggagtgacttggggagaggtgtggtgcactcaattggtttggaggtttcctgcagacaggctgagattccacatggagtcagggacatagagaagagcagcagccagctcaactgcaggctgaatctttgttcaggggtctggtgggatgtcggcaagctctgaggaagggatgagcctgcagactggctacggtagggaaaggaagcacttcaggaagaatgtgttgaggagggggtggtgagggagaagactcactttctcagagaatacttctctcttgatggaaatcacatgtgtatgtggtggagtggtggcctcaatcttcatctagtcaaattagagcttgggcttaatcttggaaagaaggaagatcaaatatttctcctttcagctattcaagacataattaagagaagtaatttatgtctgataacccttttacttttgcaaaaagcacctaccgtgttgtttgtgtgagatactagtattgttcatgtgagaaaaatataatgtgaaacaaatacctggagctgtacttccctgctggagtcccacatgtctttataagacacaggtcatggtaataaaagcactttgatttaattca

SEQ ID NO: 47838 - DNA, 301 bp, Homo sapiens
catcctctttctaaatgggctggggaaggcagtccttaggagagacagttacatgcaagggagtggcgaaggggggtgtcccacagccttcttgaaagagggcacagcagtttgtttaaaatagctgtttttcagggaagaaggaagagttaagaggaagaaagtagagcatgttttgggactgagcttgcatgagaagacgggtgccctaaggtgctttcctgtggggtagtagctgggagtgacttgggacaagaggaggggtggtcgtggggtacctgagcttcgaatttcgttaatt

SEQ ID NO: 47839 - DNA, 289 bp, Homo sapiens
ttttttctgcataaatagtattcttcctgattccagtgtacaaaaaacatcatgtgtcagtgatagtcagacatggtaagggaagatttctcagaatttattaccaaagtcttctcttgccagctcaggcagttttcttacaccctcagcgttaggtgcctcaataaagaagggttaggatgactttggagtagaaataagtatatgtatagagtgaggaatctgagataaggcataataagagggacctgaaagcccaggattggaaagaggacctagattataataa

SEQ ID NO: 47840 - DNA, 443 bp, Homo sapiens
cctctgtatatgtctgtgtcctagtactaacttcttcttcttactaggagagcagtcatattggactagggcttacactaagaacttcctttgactttgattactttcttaaagtcagaatctccacatacactcacattgttaggtactagggtctaacttcaacatatgaattttgtggggacatagttccacccataacaccaactaatttgaagactgttgcagtactcttcatttcatacccaagaactattaaaaaaagcacctcccactttcatgctaacagcacccaattcttctatgtaccaattattcctgggctttctggttccttccaagacctaggatatgaataatctaggccaactattatcatatcacttccctttccactctagtcatggacaagtgatatagccctggcctatgagatatacagg

SEQ ID NO: 47841 - DNA, 1132 bp, Homo sapiens
gctaattgtgtgatactgctaaaaagcatagagtttcaagctaattcagtccttccattttacaggagaggaaattgagactcaaattgacctgcccaaggtcatttaactggttaatatcaaaacagagacccaggacttctgactcctagtcctttggtcttctccagtaagttgcttaatttttgcttgaaaatcctacatttccttcttgtggattaaaaacaagaacaacaacaacaaaaatcctacagttctttttgcgcaacctataattttgatcattttgtaactttttgtttgtgatacattagataaatatttaatccagtgttattgagtacctattatgtgcaaggtatttttatgtgcattatctcatgataacctagagagaggtattatttctatttagcgcataaggaaacagaaatgcagatggatttgaccatctagaaagtggaattagctggtatttgaactttggttttctgacctcaaattttgggccctttctgctatgcctgcctcttgccttgctattctcagaaagagtttaagtacagaaagactcagtttttcctatggtgaaagcaagggtcatgttgggcatatggaatcaaacatatatgagtcatgtcttacaaattacatgtgttcctgtgactagattttctgctttgggctcaaaatagctacttgagggatgcttcttattcctgcctgctctaggaaattttaaagggtagcagtgatacagttagaccaatagagggtactgtatcgctatatcgctaactgtgctagacccaaatttagctcttttgggccttttctctttgctgctttgtggatctggaggtcaagaggtgatatcattttaggttttaaggcagtttactctaaggagaaattggcctttgtctttggcagcccccctctccgcccatgttgtcttgattagggtctgatttgtcatcttgcaggctgttttgcttttaaagtttaaagcgtttagatctgtcgtcaaaattgccctaaacctgaatgaggaaaaattcagaattttaaaaatgctcaatagtcagggtagtttcatttttcaaggttaacattttgctttcacatgttc

SEQ ID NO: 47842 - DNA, 2785 bp, Homo sapiens
gacgctccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaaaaaaa

SEQ ID NO: 47843 - DNA, 1835 bp, Homo sapiens
gacgctccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaaaaaaa

SEQ ID NO: 47844 - DNA, 1977 bp, Homo sapiens
gacgctccttacccagatactcagctaaagaagcagcaagcaggaagaggaggctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgaccctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaaaaaaa

SEQ ID NO: 47845 - DNA, 349 bp, Homo sapiens
caagaagatggcttgatgctttagccaaacaaaaggcaaaagtagagccaactttgattaaattcaaacaccttgtggcatttagaggcatgctcatattggcaggagaaggaaactgtagcaaatagataaggtttaaagcaatacactatctttgtttgtccaaggaccacgtagctcttccaataggaagatcatttgtttatgaggcacaacaagaaattctgcagtagttggagttgtaaggcacctgaggttccccacagcctagaagctatcagctcatcaacgaaaaggtccacctggttgatctggagtcttcagttcctgccactgggaaggatacttc

SEQ ID NO: 47846 - DNA, 1584 bp, Homo sapiens
  misc_feature (648)..(648): n is a, c, g, or t
  misc_feature (653)..(653): n is a, c, g, or t
  misc_feature (705)..(705): n is a, c, g, or t
  misc_feature (787)..(787): n is a, c, g, or t
  misc_feature (915)..(915): n is a, c, g, or t
aacgcgctccttgtcattgtcacactgtggtggcctgggtttgtcctccttgcatgtgccagcagtgattgatgactcacaggggcaattccattgtcccagagcctggagctcctgttgctccggggtcctctttggtgttgaagagaagcactcatcccttcgtcagaagacacacacacacacacacacacacacacacacacacacatacgcacactccatgtaggcttagtaagcccagccagtcagtgcccagtcagccgtcccccttccttgtggctgaaccgcaggaggtgggggtgcatctgctctgcaccactcagccagagatgcaggagcctctgcccagctcagaatagatgatgttttcttattagtggctttatttaaaagccatcccagtcatttcacattttttttttaaagttttgattgacatctatttggtcaacctgtgctccctatggactaaaatagctgactggggcattgtctgggcttattaaacctgcatgttgtgtgtgtgtgtgtgtgtgtgtgtgtgtctgtgtacacgcacgtgtgcacacgcaggacaagcatagcatggaatttgatggagtggatgtggagggaattgaagtggtctccgtgcagaaggggganggtangaaccaagtgaagtgccttgtacaggcgtcctgctgccgctagagggcgaantgagtctagaatccacatgcccgcgtcctgcctgcgagttttcccctaaagcagctgtgctggctcccggacagcagcttcnagttgacctcttagaagcccgaccctaatttccgatgggctcagggtcataaattagatttctgttctaggaaactaatttcataccaccacaatactttaaaaagtgatcacaaaatgaaatacacntatacgttttacaaataattacatgaaaacctaacacttaaggctaaattcctttggtgggtgtaggggatggggattgcttggagaagacataatgaggcttgcagtctgatgaggtttgaactgcaggtaccctctttctttcctgtgactttccctttagcaagcacagccattcctccttgccacaagggccttcaaactgtgatggaaatgagggtcatctgtcttggaaatatgcaccgctgagtggatctgcctgcccatttccggagccctgtgcctggcgactgctgggggatgggcagttgcagtggtgactctggaggggcagctcagttcataggatgtaatcatggttggatggactccagagggtcataggatcctttgaaattataagcaagtatttgattgtgagtttatctgggtagagtgtccaaagcattcactggagtctcaagggaatccatggtccccaagagacactattgtacgttcaggttcctttctagtaatacttttttctaaaaagtgtctgtaggtcagttcttctaaggacttctagagatagtagtgatagtggtacaacaaagtgaaggtacttaactgtacacttaaaaatggctaagatagtacattttatgttatgtgtattttactacgact

SEQ ID NO: 47847 - DNA, 851 bp, Homo sapiens
ctgctggcctctatccccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgacttggccggttcttgacctggtggatgtggctgcagtccagagaaaggaaagattgaggtggcagagcagaccactctcccttcccaaactgtccaacttctccccctttttgcctcctcggaagctcgctgcccagagccatgtccagaacccagccggccatctccatggtgccaattaccagcaagtgtctttcctgcggcaccgggttcaggcagctactcctgccccagagatgaaggggcagcttt

SEQ ID NO: 47848 - DNA, 532 bp, Homo sapiens
gattatgttagttttctattgccattgaaacaaattgcccacaaatgtagtagcttaaaacaacacacatttattgtctgtagattagaagtccagcaagattctcactgggctaaaatcaaagtgtctggaggcactaggggagaatcttccctttcagctttgagaggcacccccatttcttggcttgtggctccttctccaagctttccatggtcacagccccctgtctgaccactgccttttctgcttttaaggaacagtgtgattagattgagttaatccagataattcacaataatctctccattttaaggtcctaactaatgacatctgcaaagtctactttgccatagaagataacatatttataggttctacagactagaatgtggatgttctgccatacagtgctgtacccgcagagcccctagttgttctaattaaaggaaattaatcctgcgaattctcatcacagaactcctagatttttccatgtttttttatttgcaatacatatgccaaaaaaaaa

SEQ ID NO: 47849 - DNA, 248 bp, Homo sapiens
gacagactaagatggaaatcaggaagaacagaagtagaaccatattattgctacattatggaggaagagtggaaggatgatgaatgatgtaaggttctacaataagatcaagaactgagaaaagattattagatctggcaactggaagtcatcaagctccagcaagtagttttggtaaagtggagaagacagaaactgtagcagaggataaagggtaaataaagtcagaagatgtggaaaaagaaaag

SEQ ID NO: 47850 - DNA, 400 bp, Homo sapiens
agtcatctaacccttctctcagacagccattcaaggctgcctatgtctttctcaggaggagatagaatggttaagctgtcattatcttctagtgccactgaaaggacaatagtttcaatgccatattgcctgacatttaaactgatataccttgggatattgagaaacagaagggactaggggaaggagagagccagtttttaaattgttactatataaggaagattctagggattttttcccactctgaattttaacttgcattccatgtaacaaaaaatagaccatgtaaaatgaatatcatcattttatgtctattcttttatatcactgtgaaaggaagcaacagaaatttaccaaagaaccaaaggattgtgaatgacttttcagaatatgagtg

SEQ ID NO: 47851 - DNA, 468 bp, Homo sapiens
tccttaacctcttccagtgcatatgctaaaagaatcaacagttcgtttcttgcattaaattgctttaaaataagctataactattaaatcagtattcgttgaataaaatgattgcaatgaattgagaatatttgaacaaagactagatgttaaatcatattaaatgattagaattaattttgttaggtttgacatgtgattaaattacaaagcaaaacctcatctggtagagacatttactaagatatacataagtgaaatgatatgatgtctgaatttgctttaaaatactcaagcaaaagatgggggggtgatgaatagttgaaattaaatcgggaaaaatgttagttgttgaagctggatgatgggttcatgggggtttattatgctattctttctacttttatgtgtatttgaaatattccataataaaaagttaaataaatacttgttccaagaaacaaaaat

SEQ ID NO: 47852 - DNA, 668 bp, Homo sapiens
ttctcagtatggcatccccagggagccaccacgactcattagaactggaagatgccatgatccttggtttatctaacccatcacaagatctgagtcaaaggccgtacacacatggaagagagttatatctatgtctgtggtgggcatggtggctcacgcctataatcccagcactttgggaggccgaggcgggcagatgacttgagacccaggagttcgaaaccagcctggccaacatggtaaaaccctgcctctactaaaaaatacaacaattagctggggctggtggcacacacctgtaatcctgactactcagatgtctgaggcacgagaatcacgggatgaatcacgggatggctgaatatgggaagtggagggttgcagtgagccgagatcacgccaccgcactccggtctgggctacagagcgagactctgtctcaaaaaaaaaaaaaaaactacatctataaaaactagttttatgtaattaaaaaaaataagttcaacagggatcaaagaaggaagagagaaatttcaactgaaatgagcaaagtcccctctggaaaatgtgtataaaaaggtaggggctgtcaggaaagtcctaaggctgaatttccaagtcacataccccaaaggcaggtagtgtagtttatcctctcatgtctatga

SEQ ID NO: 47853 - DNA, 416 bp, Homo sapiens
atggcttctgcttatagtgaattactggacgttatttacatacaaaaggatacatttaagcgctttaaatagtttaatacccttggcaggtaactagtacttatattggtttcttatggctaccctaacaaattagcacaaattgggggcttaaaataacaaactgattctcttactggagttctggaggcaggaagtctgaaatcagtttcactgagcagaaatcaaccacccagatgattgcttcctgggactccaggggagagtgtttcctttttctcctagttcccggagccacctggactccagccatgactgccatcactgcaacctcttgctttcattctcacacctcttacttcctccttcaccttcttgcctccctcttaaaaagacccttgtgattacctttagaa

SEQ ID NO: 47854 - DNA, 337 bp, Homo sapiens
tcttaatggagtcacaggaaaaaccacagacctaccaagttgaactcaaacagcaccttgctatggcttcttttctcccaagatgtagttcattaggaataagtttctgaatgtgtatagctgagggtacttgggttttaaagcaatggagtcaagcaaaggcaatagtgagaggtttttagccctccacaaggaaaactacaagatgctgtcaaaagaaataacggacaacacaaacaaatggaaacacatcccatgttcatggatgggtagaatcaatattgtgaaaatgaccataactgccaaaagtagtctagaaattcaatgcaattctcat

SEQ ID NO: 47855 - DNA, 643 bp, Homo sapiens
attgctgctgagtccctacctccctgctcccctggcaggccccaccacactgctccacactacacgtttcctctctttctgggggtcatcgacaggccaccaaggctctgctgactcaaaacaatcagctgatcttcagcagctttggggaacctcagacaggtcttactctcccaccatggagctgaatggctggggtttacatagcacttacacacacacacacacactcataccccaaatggagtcaaacaaataatgactcaaattccaattctaccacttactggccctcttatcttagagaagtttcttaatttctccaagcctttgtctcatcctggtaaaagggatccttaaatgcctggcatgatccaggcatacagtaaaagctaattatattgtccatttttagcaggatccatacactatttctaactacgtatacattattaagggcaaagcaaataaacctgttcatcattcattgttcatccaattaaaatgctttgactggcagggcacggtggctcaggcctgtaatcccagcactttgggaggccaaggtgagcggatcatgagtcaggagatcaagaccatcctggctaatacggtgaaaccccgtctctactaaaaataccaa

SEQ ID NO: 47856 - DNA, 967 bp, Homo sapiens
tggaatgtctgtttacctatattctcaacacaatattatcaatcttaatcttcagtccaataggtaaaacattgttagaattggttataccgtgtcttaattattcagtgaagttaaatgtcagttactgtttgtttatatttgtgaattggctgttacagtgttggatcttgtgcaattaggttgggcttttcttatgattcataaggactttttgtatattacaaatactagtcttggcctcccaaagtgctgggattacaggcctgagccactgcgcctggtcttgcccactcacttgaacctctactactttgtagtattaaacccagatccactgatttaagcaaggcttcaaaacaattttactgccacagcctatataaactatagatttatataatactctctgttccattttagttgatttttcccccaatgacagaaattgttcttttttctactcacaggactgttattgaattagaaatttgaatttacatgtggtggatgaacatcactcttgttacctgcttcatgtacttttttgagtgcttactacctgtgatgattattctgtttctgatctccagtacttagcaaaactggagtttttccgcaaagctgcagatgagggaatgatttaccttaacagcccttcaggattttaacctaggattaagtaggtttgcatgtttgtgattcctttcattcagggcccggcttctgaaggtaggatgcggggaagagctttaaggatctaaatttcctcccagcctgagcaacatagtgagatcccatctcaataaaaaataaaaaaattagccagatgtggtgacacgtacttgtagtcccagctactcgggaggctgaggtgagataatcatttgagcccaggagtttgaggctgcagtgagccatgattgcaccactgcactctaaccttggcaacaagagctagaccctg

SEQ ID NO: 47857 - DNA, 192 bp, Homo sapiens
ccttttttttttttgagccaaggtctcactctatcacagctctatcacagtggcatgatctcactctatctcactctatctcactctatcacagtggcatgatcacagctcactgcagcctcgaactcccagactcaagtgatcttctgcctcagcctctgaacagctgggactacaggcacatgccaccat

SEQ ID NO: 47858 - DNA, 654 bp, Homo sapiens
ggctataccatctaggtttgtgtaagcacactatgatgtttgcatgacaaaatcgcctaatgacacatttctcagaatgtagttggaggaaaaaaattgaaaggagagtattacttcatgacacaggaaaatcatttgaaatacaaattccagtgtccataaataaagttcactagaatgtggccatgctcattcatttacatgtaatctgtggtagtttttgtgctactgtggcagaattgaatacttgcagtggaacttgaatgggctacaaggtgtatttagtacctggcccttcacagaaaaagtttgctgacctgattgaatgtgcttgtgtgtatcacaggaagctcaccaggactcttggtatgtagcctctagctcccaaaggcatctgagccccactggcaggactcagttacctgtctctgtctaagcatgactccacccattagcgtccagacaacgaagaaaacttctattttaaagagcttgactaaccccctccttattatctaagttagagtagctgtgccaccccttaagtagcttttccttcttcctttcaaataggggttggaagagtagcaggtgagaacaacctctttcttcctcaattgtagagactcaatagtctaggctataaattaaaaa

SEQ ID NO: 47859 - DNA, 161 bp, Homo sapiens
tatttttaagctaaatctcacattgcaagggaagtccactttatgttttcagtggaagaaatgaaaaaaacaagcagtattctcagcagcactgatatagctacgagaacctatgtcagagagatgctttaaaacaggagtcagcaaatttctcttctaaa

SEQ ID NO: 47860 - DNA, 579 bp, Homo sapiens
caatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaactcttgaggaaattaagtcaaaaaaaaa

SEQ ID NO: 47861 - DNA, 254 bp, Homo sapiens
agtgatccacctgccttggcctcccaaatgctgggattacaggtgtgagccaccatgcgcctggtctgtgtttttctgttttgttttcttaccttacatagttattgttgatgtacctccagaaagatgtagaacttttttttcttttttttttgagacagggtctcactctgtcacccaggatgagcgcagtggcacaatcacagctcactgcagcctcaaacttccaggctcaagcgatccttccacctcag

SEQ ID NO: 47862 - DNA, 423 bp, Homo sapiens
gtgggttttagggtggagcctaaaatcttgcatttccaacaagctcctggtgatgctatgatgctagtccgtagaccagctaagtagcaaggagccagggacattcagattacactatgtatgtggttttgcaccctgattttttttttccttttaacctcttaaaactttttgcttaacattttacataaatgttttccctatgatattaattattctttagactcatagtttttaataaatgtgctatttagttacttggatgtgtagtgatatatttgataactaccttttgtttgaaatctaaaatgcttcctgtttttacctgtcgtaaatcatgatgtcatgagcatccctatttataaatctttgttggcttctctgcaccaaaacttgcaagcaggacagagcattccattaggg

SEQ ID NO: 47863 - DNA, 395 bp, Homo sapiens
ttgtatttactaaatacaaagatatcctcccacacaaccatagtaaaacatcaaaatcagggtagtttactatgggattaacactgaccccatattaccatctaattcatagactttatttagattttttcagttgttccaataatatgctttgttgcatctaaaccaggatcatgtgtttgttcagttgttttatcttattttttccttttcttttctttttaaaatagagatggggtcttgctgtgttgccccagggtggtcttgaactgtcggcctcaagcattcctcctgcctcatcctcccaaaatggtgggattacaggcatgaactactgtgcctgggcaacaagagcaaaactgtctcaaaaaaagaacaaaagaaattcctgccaa

SEQ ID NO: 47864 - DNA, 517 bp, Homo sapiens
aaaccttgcatcttacatgtgaaaatagccacagaactggaaaggatggtctgaagaggggactttcaatatttcccagcagattctcagacagactcaccttggcccattattggatcaaagtcaatataatattaggttaacttgacttatccagctggtgagatgcatcctgcagtcttgagtgcagaggcttctttgttttgtttggggttttgttttgaagtgttttgcattaccagaacaagagttcccaaaactcgggaagttgaaaggtctctttaatgggcacggatgaaaataaactgacatggcaacaaattatatttggcaaatagacatcggaaagcagatattcaggcttcctgggcagggcatagtcctggcacttttcctgaatgtgaataatcaagcacagggcagatcctggaggagcacacttgctccctattgcttgatgaagcaaggccttctcttttacctgctgttgggctgagcaaacaaagcccaggtgagc

SEQ ID NO: 47865 - DNA, 318 bp, Homo sapiens
ggaaatgtgaaacgatgacacatcatcactctccactagagccctccagtttctgagaaagatggaaactctctcattggaaaaggcagaaaaataaacatgctaacaatgaaaattcttaagatttttttaaaaagagaaactgagaggaaaaatcatatctaagttcttctagaaagatcacaatttcacaaaacctattgtttggaacaaaaacctgggtttaagtttattttatttagctgagcacatttagtagaattatttcaagtgtctgccttagtacagacttttcagaagtgggataaatgtacagtt

SEQ ID NO: 47866 - DNA, 1276 bp, Homo sapiens
agggaactggattttagtacattatgggtgtatgagatgattggagccttaatgaatcattacatgctatcattgaggcgctcctcactgtatggttttcagatacagagaacctagtgtatgcatgagaaagtaaatctcctcccttcctttgctggaaggaggagagcagttgccacccaccagtgccctggttggtcatagtgccttcccctttagatggactcaggacaatggcagagcaaaagacagtggaagcccacaagctccctgcagatctgcagcacccctgggactttatattcaccttgtccccttccttgcttgtatgttgactgaccctgatatttagcaattttcatgggctaaatgatatacaaggctaatatgggccaggcagttttaaccacaatctggacacatttccttatgtggaagtggattttggaaaatcattttctgtttttgttgttcccttctcattaagccaacatgtatattcataattacaccctttatgtcaattgacacactttcctaccttgatatggactgtgaaaggaaaataaatcttgggacccccaaatcgctaagctaaagggaaaggtcaagctgggaactgcttagggccaacctgcctcccattctactcaaagtcacccctctgctcactgagatagatgcatatctggttgcctcctttggaaaggctaatcagaaactcaaaagaatgtgcctgttcttctctcacttatctgtgacctggaagcctcttccctgcttggagttttcctgactttgcttcaagctgccctgcctttccaaacccaaccaacaaatgtacttcttacgtttcttgattgatatttcctgtcttcgtaaaatgtgtaaaactgagctgtgccccaactaccgtgggcacatgtcatcaggacttcctgaggctgagtcacgggcacatgtcctcaacctaggcaaaataaactttctgaattaactgagacctgtctcaaattttctgggtttacaggacctgcatgatatgaaagctatttcatgatttctcagattgtttctgaaaagtatcattgtaactcttcatcctctttgcaataggcttatttggttcagttctatatgaaggttttcaggttgaaagttctgccagtaacaaaatgacttggctgtgttgttcacttgaaaacgacaatgttgttgcctagccttcctgtcgaagattgaattttggcttgttgagagcttgctctctgttcta

SEQ ID NO: 47867 - DNA, 562 bp, Homo sapiens
gtgacctgacttaggtgttaacaggttcctctgaggtgtgtggggaacagactgaggggtttcaggggacatctgttctcaccacaaattgccccccaaccagccccagacatgaacagtctcccgggagctccctctagccttctcgtatatcccagccctgcctcatgtcacaatttgtaatgatgtgtttggctgggtgacattttatggccatctgtctccctatcccctataatgtggtttgccgaaagcaaagcccaggactgtctcggccatctgtgtctccaggatcacccctcactgggcatggagtatgtgtccagttaacgcttgctgagtgaatgaatgaatactccatcctctgcctggagaattacgcactttagcatatccaaggctctgacaagtcctgcataaaagagcattattgttttctttctttctttccttctttccctcttcttttctttctgactataggatattgattatcaatctggcaatagtcaagattggcagtctggtgtattagtcaaaggttttcagcctacaaaagaca

SEQ ID NO: 47868 - DNA, 1330 bp, Homo sapiens
tgagtgagaatatgtggtgtttggttttttattcttgcgatagtttactgagaatgatgatttccaatttcatccatgtccctacaatattctttatacaatctgattcaaatattaatctcatccagaaatacagacataccgagaataatgtttggccaaaagtctgagatccccgtggcccagtcaacttgacacataaagttaaccatcacacagtcgtcttacaaaatatacactagaaggcagatatactgtaatatgctccccctatagttcactgaaatacagcagatatttgttgcccatagcagagaaatgcaatctgctaatcaaatacaaaactttgtttttctcaatctgaatttatcagtgtttgagggagtcttatttaactgaaagcttccaagaatttaaaatgaggcggattgctcattctgacacttggattcatgtttagttttctctgtccactgcatgcttgcataggcagcaagaggtctcaccatcactcttcatactgcatgatgatctgctgataaggcctcacatttcatccccattttcccagtgtcaatagcccctcaatctcccaaccttaagagatgtgaaaaagaattatactttatagatgcctctgtggacagcaaggaagaaaggggtatacccagctgggagatcttggtgctgccttagaaacacctgatgtggcttcatgaggtgacttctgttttggaggtggagtggaagacagcagcagtggaaaatgatgatgggtagagatatgtagggccaatgagttggagacattttagagtatgccataactgagaaactttggatatagagggaaactaaccaatttttaaaggaagatttccaattaaaatcagtgtgaacccccaaaccattaccattttgtctaaataaacttcactggtttctgtttaagcaaacattattgagttttgaggatttgaactctagtttctactactgccaaattatgcaaagactagactacataggctcctagtatttattaggattatacattggtgagcatatcatgtgaggatcacataaaggtgtcgttagtaagaatggaaacttttaagtaagcaagtgagatttgggagtaaatcctggcccatcgtctgtcataaatgttgtcttaaataagcttcattaagttgcaagatgtataaacctattcagactagcaaaaagtattctatttcaaggacccgtggataatttcacaggattgaggaatatggcaatcaaccagctctcataagggcataaccagctacttgttagaaaacca

SEQ ID NO: 47869 - DNA, 262 bp, Homo sapiens
ttccacctgcccatgatcaggtccaaggagcggggccggcggctccctgcacctcctcgcaggttgagcagctgttggcaaaggccaacgtaggggcagatgcctggggtcccgaccatgatcaggaagggcagctccgggccaaggctgctcacaggccgggaggtggggagtagggcgaggtcaagcaccagaggaaggggctggcaggggtgaccaggaagaggaggagcagggacgtggagagccagcgcataggagc

SEQ ID NO: 47870 - DNA, 509 bp, Homo sapiens
  misc_feature (79)..(79): n is a, c, g, or t
  misc_feature (116)..(116): n is a, c, g, or t
catctgactgcccataatagctattctcataacgctcaattaaccactacgcatcatacagccaaatatcgtgcctatngtcatactagtctttgccgccagcgaagcaacggtgngcctagccctactagtctcaatctccaacacatatggcctagactacgtacataacctaaacctactccaatgctaaaactactcgtcccaacaattatattactaccactgacatggcttcaaaaaacacataatttgaactcaacacaaccacccacagcgttccacaacagggtcgggctcagagtaggagctcagtaaatacttgtggaatgaatgaatgagctcattttacctcaatcacaactccaggggtagacatggtgatttcactccattctatggttgaagctcagaagcttacggaacttgcccaaggtcacatagttagtaagtggctgagtgacgcatcaacccaaagcctgtcttactctggggtcctggatcttaac

SEQ ID NO: 47871 - DNA, 380 bp, Homo sapiens
cccagcactcccaggccctcactctgcttcctttattttttccatttcgccagccatcttccaacacatgggaccacatccttatttattgagtgtcttgttgcaggtctctaagactgtgcctgccttgttcactgatgtatctctagcgcctacaacagggtcgggctcagagtaggagctcagtaaatacttgtggaatgaatgaatgagctcattttacctcaatcacaactccaggggtagacatggtgatttcactccattctatggttgaagctcagaagcttacggaacttgcccaaggtcacatagttagtaagtggctgagtgacgcatcaacccaaagcctgtcttactctggggtcctggatcttaac

SEQ ID NO: 47872 - DNA, 355 bp, Homo sapiens
aatcatttacattattaaaataaagaaaaaagcaatatcaagaattttcaggctgggcatggtggctcacacctgtaatcccagtactttgggaggctgagacgggaggatcacttgagcccaggaattggagaccagcctgggcaacatagtgcaaccccatttctacaaaataaaataaaaaaagaatttatacatatcttccaacatgcttgtcttccacaaacttcaaagtaccctgattattagaattagaactcagttcccatcacactttcctacaaatcacagtcaatattatttcttctttataaaatgaagctctaaagtacaagctatttgtctgataacagag

SEQ ID NO: 47873 - DNA, 544 bp, Homo sapiens
ctctgctcatttttcaaaccacactagggtacagagctcgtgcttcgggatggaaacctatggttatctgcagagggagtcatgctttcaaggacctcataaaacaacatggcagacatcacaatgttaccgggggtccttgctcccagagctcccaacatggtggcgggttgcttccaagatggcagcaagcctctcgttctctgacctggggttcttggccccacggattccaaggaatggaatcttgggccatgcggtgaatgttatagctctattggaagacgtgggtcatggaagagaaccgtagaacccagcgactagtgttcatctcaattaggacgaacccaggcacttgccgtgcaggaacaacggcaagccttcagcccgatcgggagcagcagtgggcgcctcgctggatcaggagcacagcagacaccctgccagatccggaggggtggaagtcagcggcgggtctgcgactgcggcaaacagcagtggtggacaacgagcgaaagcttagcttgagcggtaacaaacacgg

SEQ ID NO: 47874 - DNA, 494 bp, Homo sapiens
caaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacagagcgagactccgtctacacacacacacacacacacatacacacacacacacacaaaaaaaaaa

SEQ ID NO: 47875 - DNA, 3768 bp, Homo sapiens
ctctgctcatttttcaaaccacactagggtacagagctcgtgcttcgggatggaaacctatggttatctgcagagggagtcatgctttcaaggacctcatgaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccccaggctggagtgcagtggctcaatgcaacctctgccccccaggttcaggtgattctcctgcctcagcctcttgagtggctgggattgcgggcacatgcaccacgcccggctgatttttttttgtatttttagtggacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47876 - DNA, 3757 bp, Homo sapiens
ctctgctcatttttcaaaccacactagggtacagagctcgtgcttcgggatggaaacctatggttatctgcagagggagtcatgctttcaaggacctcatgaactctattttaagaacctctcaaaacgaaacaagcaaatcatggagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatggaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataataccttccagctgggcgcagtggctcacgcctgtaatcccaacatttcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47877 - DNA, 3575 bp, Homo sapiens
acccgcgcgcccgagcgcggaaaccgaggggcaggctcgcgctctgcctgcttcgtggcgcttggttcgtccctcgcccgaggagcgcggtggcggcgtgggagggagcctctgacggcgtctgaaatacatatcgaatgattgaacaagatgactttgacattaacaccaggctacacacaattgtgaggggagaagatgaggcagccatggtggagtcagtaggcctggccctagtgaagctgccagatgtccttaatcgcctgaagcctgatatcatgattgttcatggagacaggtttgatgccctggctctggccacatctgctgccttgatgaacatccgaatccttcacattgaaggtggggaagtcagtgggaccattgatgactctatcagacatgccataacaaaactggctcattatcatgtgtgctgcacccgcagtgcagagcagcacctgatatccatgtgtgaggaccatgatcgcatccttttggcaggctgcccttcctatgacaaacttctctcagccaagaacaaagactacatgagcatcattcgcatgtggctaggtgatgatgtaaaatctaaagattacattgttgcactacagcaccctgtgaccactgacattaagcattccataaaaatgtttgaattaacattggatgcacttatctcatttaacaagcggaccctagtcctgtttccaaatattgacgcagggagcaaagagatggttcgagtgatgcggaagaagggcattgagcatcatcccaactttcgtgcagttaaacacgtcccatttgaccagtttatacagttggttgcccatgctggctgtatgattgggaacagcagctgtggggttcgagaagttggagcttttggaacacctgtgatcaacctgggaacacgtcagattggaagagaaacaggggagaatgttcttcatgtccgggatgctgacacccaagacaaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataataccttccagctgggcgcagtggctcacgcctgtaatcccaacatttcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47878 - DNA, 2655 bp, Homo sapiens
  misc_feature (30)..(30): n is a, c, g, or t
gacttgcttttcttctcatttttccctctncgttcttgtcacggtctgctgacacatctagataaaatattgcaagcactgcaccttcagtttggtaaacagtacccttgttcaaagatatatggggatggaaatgctgttccaaggattttgaagtttctcaaatctatcgatcttcaagagccactgcaaaagaaattctgctttcctcctgtgaaggagaatatctctcaagatattgaccatattcttgaaactctaagtgccttggccgttgatcttggcgggacgaacctccgagttgcaatagtcagcatgaagggtgaaatagttaagaagtatactcagttcaatcctaaaacctatgaagagaggattaatttaatcctacagatgtgtgtggaagctgcagcagaagctgtaaaactgaactgcagaattttgggagtaggcatttccacaggtggccgtgtaaatcctcgggaaggaattgtgctgcattcaaccaaactgatccaagagtggaactctgtggaccttaggacccccctttctgacactttgcatctccctgtgtgggtagacaatgatggcaactgtgctgccctggcggaaaggaaatttggccaaggaaagggactggaaaactttgttacacttatcacaggcacaggaatcggtggtggaattatccatcagcatgaattgatccacggaagctccttctgtgctgcagaactgggccaccttgttgtgtctctggatgggcctgattgttcctgtggaagccatgggtgcattgaagcatacgcctctggaatggccttgcagagggaggcaaaaaagctccatgatgaggacctgctcttggtggaagggatgtcagtgccaaaagatgaggctgtgggtgcgctccatctcatccaagctgcgaaacttggcaatgcgaaggcccagagcatcctaagaacagctggaacagctttgggtcttggggttgtgaacatcctccataccatgaatccctcccttgtgatcctctccggagtcctggccagtcactatatccacattgtcaaagacgtcattcgccagcaggccttgtcctccgtgcaggacgtggatgtggtggtttcggatttggttgaccccgccctgctgggtgctgccagcatggttctggactacacaacacgcaggatctactagacctccaggaacagacatggaccttctctccagagctcctgagtggaatcaagttcttgtctttaggatgaccgtttcttaacaatcaaatctggtattgaactgcaggtgactttggcagagaaatgttttcacttttggtctcctcttccagagtcacctttccccactcctatttttgtagatgctattctttctgatgtcttcttactaggggtcattttagctcaaaccctgtaagttacagtcacaattttctgtgccaaagcagctacaataatagagaggaagccttcttagaactctgcttactaatgtattaataccactgagaccttcaggccttgcctgggatatcacttcatcctgaagtttgcattaataatccttccaggccgggcacagtggctcacgcctgtaatcccagcactttgggaggccgaggcgggcggatcacgaggtcaggagatcgagaccgccctggctaacatggtgaaacatggtgaaaccccgtctctactaaaaatacaaaaaattagctgggtgtggtggcgggtcccagctactcgggaggctgaggcaggagaatggcatgaaccagggaggcggagctggcagtgaactgagaccgcaccactgcactccagcctgggtgacagagcaagactccatctcaaaaataataataataaataataataataataataataataataataataccttccagctgggcgcagtggctcacgcctgtaatcccaacatttcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47879 - DNA, 1326 bp, Homo sapiens
caaagttctggctatgaattgttaacttggaagaaatactaactgccaccacttattaagtgcctactgtgtgccaggctctgaactaggtgcttcatatacattatcctaaattatctcaacatatgaggtaggtgttttaatttttattttatagaacttggtgtgtttgactgttaagctatggggctagagagagggtttgatcccaggtccctctgtgcttttgctgctgagccacacaacctctcatttcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacaggtgttctatttttttgagacgggtctcactctgtcacccaggctggagtgcagtggctcaatgcaacctctgccccccaggttcaggtgattctcctgcctcagcctcttgagtggctgggattgcgggcacatgcaccacgcccggctgatttttttttgtatttttagtggacagggtttcaccatgttggccaggctggtcttgaactcctgacctcaggtgatccgcccgcctctgcctcccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47880 - DNA, 805 bp, Homo sapiens
tgattctagaggatcccagatgacacttcaggatgaagtgatatcccaggcaaggctgaaggtctcagtggtattaatacattagtaagcagagtactaagaaggcttcctctctattattgtagctgctttggcacagaaaattgtgactgtgccaaagtgctgggattacaggtgtaagccatcacacctggccctagtgacaggtttttatgggtacttttagatgatctaagaaatcatgtgcatatatctttcagatttttattttgggaaaatgaaggtttctacaacatattgtttcagtgttcaaataaactgaaggactcaacattacatttgaactatatccttcctagtgggttagtgtgaaaaagagtttggctgattcctaaaactctgccagccctgcagtaatctccagggcctggttattgttcagacattccatggtgattcctgggaaggaagcttggctgctcagtttctgagtctggggtgagataatgttctgggaagggacatctgttctttggtgtaatctctcatggtgaaatctgctctgtacatcagacaattgcattgctaccaagtttcataccaaatatttgaaaggatggtattgaatctaaaaccaaatattagtttttattaaactcatgggaaggctaatatattccaacgtaaattattacatatggttaagtaattgcatgttaatttattttaatgtaaatatttttgttactgttctgagccaaattctaaagaaaaaataaatacatttccttgttgaaaaaaaaaa

SEQ ID NO: 47881 - DNA, 376 bp, Homo sapiens
cccacttccaaatccttgtaatgtgtcactggttttacctaggggagaatgttcttcatgtccgggatgctgacacccaagacaaaatattgcaagcactgcaccttcagtttggtaaacagtacccttggtgagtataaaacattctttgttgagtgatttaaaaggggagctaccttcagtaccattttaaagctacaatcactgtttaatcatcctaacagagctttccttcttatgcctacgggcccctagttgctggggagacagggattgctaatatcatacccattattactgttccaaaggttccaatgtagaatacatattttatttcttttttttttttttttttttgagatggactcttgatctg

SEQ ID NO: 47882 - DNA, 769 bp, Homo sapiens
tcgaaaattaaacttattttctattttctttgcttaacatccattaaatatgtcttatctaaacttgggtttagaaagaagtgatagcataagtgttcatgtgattatactgtaactaggtcttttttagaacatagagacagggtctcactatgttgcctaggctggccttgaactcctgggctcaagtgatccacccgcctcagcctcctgggtagctgggtcttacttggaatgtagtgtagtatcaaattcctcaacatgagtactattttgcaagcctgctgtctgctgagttgtctttttttttttttgagatgaagtcttgctcttgtcacccaggctagagtgcaatggcatgatctcagctcactgcagcgtccgcctcctgagttcaagtgattctcctgcctcagcctcccaagtagctgggattacaggcatctgccaccacatcgggctagtttttgtatttttagtagagacggggttttaccatgttggccaggctggcctggaactcctgacctcaagtgatctgcctgtcttgacctcccaaagcgctgggattacacccacccactgcctcaggcataggacacgtgggcttttccagaactttaggtcagaaaatgcgttgcttactaaaacagaatcaaaataggcatatgtccgagcactttgggaggccaagaggggaggattacttcagcttaggaattcaagaccagcctgggcaacatagtgagacgctgtcgctacaaaaagg

SEQ ID NO: 47883 - DNA, 382 bp, Homo sapiens
gtagcattctgctttctgtttgggtggccccacaaaggttagagtagcaaatagagtcaaaaccctgatcactctctctaaggggcacaccatgccttcctaataagaatgcccgcaccagatctgggctggttattgacaccaaacttgatgcaacatcgaagtccaatgtcaccccactttggtgtccaatgcaccccagcttctgagtctctgtaactcagggtcaactagaaagcatggcccagatcgggggtctcccgagtgtgcaggcccctttctctgggcgacttctccctgtgtactatttgcttggttgtgatcacttcctccctgagttttttattctgttgaggtttttgccttgccactgggagtcttt

SEQ ID NO: 47884 - DNA, 471 bp, Homo sapiens
gcataatgaaagattagggtgaaatggccagcttcttcctgcactatgttaatgtcacacctggtccaaacaatctttgggccctatgtaaatcagacactgcctactcaagctcatcaataaaaccctgtgcatttcaccacagaaacagaagacccactggggtgtccctctctttctgcaggagggagagctatcctcttttctctttcttctgcctattaaacctccgctcttaacctcactccacatgtgcccatgtccttaatttccttgacatgagacaacgaaccttgggtattaccctagatgaatgaggccacttcaatactacatgtgctactgtacccactcctgcctctttggtcccagtcctggactaacagggtggcaaagtcacataaaagaaatactccaaacacagtagtcatgcatgcaaaaggcattactatcagaaaggatttgctgaat

SEQ ID NO: 47885 - DNA, 442 bp, Homo sapiens
taagatggtgtttctagaaggcactgaagaaactatataagttttcaaaattacagctttaagaaaggaggtgctaagaaatcagtaaactatgttgtcatttcagcagcaaacacgtggatggagctgagttgaagtatacagtgatttagcgtattatgagataaatctgtccacactgattttgttattttagctttttttcttcttcaacctgggcctttctggtttgggatttatcattcatcttctatgtgtcatattcattaattcccagaaaataggacacttatttgttgcatggctgggggaaatcctgaaagaagactgtagttttaactttttaactaataattaacatttaggccaaattttaatggaaaacaatgtacccaaatggcataacaaaggtttattaatcccctaatattctgtaaccctt

SEQ ID NO: 47886 - DNA, 662 bp, Homo sapiens
aggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggccgatgccgcatgcctgtaattccagcactctgggaggcgaagcgcttgagcccaagagttcaagaccagcctgggcaacatgggaaaaacctgtctctacaaaaaa

SEQ ID NO: 47887 - DNA, 202 bp, Homo sapiens
tatccctccacccctacacacacaccacaaacaccccacatccttggtagctaatgcctttcgggtgggagccctgaagcccctcccatgtgcataaccattgctttttattgaagatgattgcctgtggtagatggtaaaacatatttaactgcaaaatgacttttattttatcccaggaagggaaaaaaatactttagga

SEQ ID NO: 47888 - DNA, 431 bp, Homo sapiens
atacctttcacccaaattacccaattgttaatatttctgaactattaaagaataagttgcaggcgtgttgcctcattacagcttaattcttcagtgtacatttttaagtaccaggacactccagtataaccatcattaagaagttaacactgatggtatactacggtctaatccaccagctccattcacatttcattgatttgagccaataatgtcctttatcagtctaggatcacatattgcctctacttatcatttctctttagttttctttattctgaaacagtccttgtctttcatgaccttgacactttgtcaagaatacaggccgggtatggtaataccagtgctttgggaagctgagcatgagaatcgcttgagcccagctgtttgagaccagcctgggcaacagccagaccctgtgtctacca

SEQ ID NO: 47889 - DNA, 601 bp, Homo sapiens
gcactggcaagcaaacattgttcagtttccccaccttgctctcggacaactttgggactctaggattattttctaatcggcgtgtttgccatgaaggaagcgatttaagactaagcagagagcaagttttaaagcccgagaaagtggagtttaaatgttctcaatagacatatcccgctccaactctgcccgccgcggcttggaaattacagcgaacaaaacccccagccctgcgcgctgagcgcagctctgcaagcgccggctgcacgcttaattggttgcatccgcagacaaaaccctccactccgcagggtcccgggcgcccctcgatcgtcccctactcaaccgcccggccactggccttggagaagagcatttaatggctgcagctctgaggcgcgagatccaggggcaaaagggggaccgggcccctgacaaggaagcgaccctggctaccctgcactctcttggacactcctttcaacgcgcccttagctgggcgagttaaccccgtcctgcggggaaccaggctccccgtagcccctgccccgggctccctccgcggccgccgcatatttaaagagcccaaaaaggaccaggc

SEQ ID NO: 47890 - DNA, 364 bp, Homo sapiens
tgcctcagcctcccaaagtgctgggattacaggcatgagccacggcgcccggcctaaaagttcttctttttaaagatgtattaacctgtcctttgatactacacccaaagtgaacaaatgctagtttcttattttaaaaaaaaatgtttatttattttaaaaaagaggcatggtctcactcactatgttgcctcggctggtcttgaacttttgggctcaagtaatcctcctgccttggcctcccaaagtgatgggattacaggtgtgagtcactgcgcctggcttattattccttttttttaaaaaaaactttttttgggggcaggacataggatctcgctttgtcacccaggctggagtgcag

SEQ ID NO: 47891 - DNA, 789 bp, Homo sapiens
cagcttctccaggtcaactccttcctggaggattcggatgacttcagacatcatgggtgcaagacacctggtggtatagaagccaggtccatccataaccacaatgatgaccttcccctgcttgagactgactgccacagctgaagcactgagtgtctttggaagttttctcggttgtgatcatctccagcagctgcatcttgtccatgggagagaagtagtgcatgccaatcaccttctcaggtcttttgctgacagcagcgatttcactgattgggaaagcagatgtgttactggcaaagacacagtgatctggaatcaccgcttctacttcctttagcactctgtgcttaagactaaggtcctcaaacacagcttcaatcaccatgtcgacctttaaaacgttgctaatcaagctgcccagttgaaggggtggcctgcccctccacatctgtgggtgtttctcgtcgggtgggacgagagactgagaaaagaaagagacacagagacaaagtatagagaaagaaaagtgggcccaggggaccggcgccggcaccggtctctgagttccctcagcatttattgatcattatctctgccctctcggagaggggaatgtggcaggacaatagggtaatagtggggagagggtcagcaggaaaacatgtgaacaaatgtctctgcatcataaacaaggtaaagaaaaaggtgctgtgctttgatgtgcacatacataaacatctcaatgcattaaagagcagtattgctgccagcatgtctcatctccag

SEQ ID NO: 47892 - DNA, 402 bp, Homo sapiens
actcatagccttggctcgaaaagcctgtacccgggattctttcctgtgggggcaattttggtgcctgcaattagctgaacaggcagcttttgtcccctgctaaagcactcaattgcaggtgtaattaggttccctcacccctgaaatctgcagagagccgcccgccttgactaactgcacccacaattaagtgcttacgggcatgtggctggagccgggaaacatgtgcatgcagctaatagcaggggcaccaagcaggtttgcaaaaatagacactgcggtggagagatccaggctttttgcatttgttgttcaaacggctctgtccagctgggaataacgaggaaagacaaacacaccaattaggctgggtccatacataaataaactgcacagctcctt

SEQ ID NO: 47893 - DNA, 179 bp, Homo sapiens
aaaagagtttgaatcagcacaaataattaaaattatggaccctactcataggaccatcatacataaagaataacaccccttttgcctttatttggagaatattactcaaccacttcaccatttataagaataataacaaaaatgggattttcacattatgactttaaagttgaaggatc

SEQ ID NO: 47894 - DNA, 433 bp, Homo sapiens
tgtgtagttctgtcatcatcttctctttggtacatttcattcacctttataaattcaattaacacctccctgtcttgctcccagtttttccccagcctctgaatatcccaactgcctgctgaatacatctcaacacataccacatctaaaataaaatccaccatttttcccctaaagctgttcttccctggttcagttagccaaaaatctcagtcatttggtccgcagtctgtacaaagctgatcacatggtagttgctcaatatacactgctggtttattgaccaaattgaatatctgcctgcagttacaatttgtaagagtcagcctagatcattcagagatagttgttctggttgtagatttcccatatccttatttcttttcaaaattattcttataatacagcttcaagacattggacagaggcagga

SEQ ID NO: 47895 - DNA, 2917 bp, Homo sapiens
aacaactttagtacttggctttgtgtgaaagaaaacagaattccctatgtaatacccaacacaccatactcatgcaataaatattggtgaatacaggtgctgtactagagatgacaaaagtacaattaagagtcctatttttcactggatctactagttgaataaggatgccatatactaaagcatagaaaagttaaatatccattccctataaaatctaagaaatactatgcagtaatatgtcataaattgccaaataataatttactgtaatacagaaaaagatctgcacctatgtatgaaaagattctcagaaaactaagaataaagggaaattctaacttgatacatcctgtgcacctcaagtctatagcaaaagttacatttcattgagaaattttgagcacaatttaagtaagaggagaagataagaaagaagaaataaagttcactattcgtatatgatatagtcatttgtataaaatccaaaacagcaaactactagaactgagaaaattcagcaaggttgtctaatataagattaatttataaaaagcagttgttttttctataccgagagatcagcaatcttttttaaatgttttcagctttgtgggccatatggtctctgtcataactataactgctgatgtagtatgaaagcagccttagacatcatgtcaagacatggcaatgcctgtgttccaataaagctttctttgtaagtagatggcaagcttggatttggcctgtgagccataaatttctaacccctgccatttatcatgagaaacccacttagaaaatagtctaacaaaaattaacttaattaaaaacgcataaaaccttcatgggaaaaaaaaaatctaagtttattagaaaataaaagattgttatgtgatatatggcttaacctagtaatgcctgttttctttaaagcacatcagtgtctcctgttcaaaattttttttttcctagaaacttgacaaattcattttaaagttagcatagaccaatacaggtccagaattagctgagtcagttttgacagaaagaggaaggaaggaacactagacctacaaggtaaatgagagttactgtaaaattatactaataaaaacaacataatgctagcaaaagaaaggcaaatagattggtataaactagtaatctcagaaagattcatgtatatttgacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggatcatagaacataatgttcaaatttagtagatctgattacatcagaattaaagatttctgttaaaagaactatacacagagttaaaagtcagatgtcagctttggaacttttaaaacctaaagggaataatacctgtaatatattaagaactcctaaaagttaacagaaacaaagaacaatagcttttaaaaaaataggtaaaagatactaacagacaatttaaataaagggtagctaagtgctaacaggtagatgagaagatagacaaactcactagtaatcagaaaaaaatgaaagtaaatgagatacaatttttcacccatcaaaatgacaaatatttaaaagttttctgatgccaagtattgggtatggtgtagatatctgtgtacttacgatgtgagtgtaaactaatattgtcattctgtaaaccagtcaataattaaatcagaagtgtttaatccctctgacccagcactcagaggaatttttaaacagatctttgaggatataatctttgtagctgcatagtttgtagtagtggggatttggagatagcctagctaaatatccatcactggtaaatagagcaaataagaaaaatgaaatgggagtaacaatggtgagatctttaaaactagatgaaactttaaaacatacagttgagagaaagaaacaatgagattcataaatatttaagaaaatagaaaaagcacagtagaaggaaatcggagtagagataataggaggaaagaggaaacaagtttgaggaaatatcacttgctaaatttatttatattatatttctatagatgaagcaaggatgatacagattcttttttctggatgaagcctggcttgaaaaaaaaacaaatggggctgggcacggtggctcatgcctgtaatcctagcactttgggaggccgaggcaggcagatcatttgaggtcaggatttcaaaaccagcctgatcaacatggtgaaaccccatctctactaaaaatacaaaaattaggcatggtagcaggcgcctgtaaccccagctattcaggaggctgaggcaaggagaattgcttgaacccaggaggcagaggttgcagtgagccaagatcacaccactacaccccagcctgggtgatagagtgagactccatctcaaaaaaaaaaaaaaaa

SEQ ID NO: 47896 - DNA, 682 bp, Homo sapiens
ggaattggggatgggagagcagctcaaagtgggaaatatggagaaaggagagacattgtggaaaagaagagataaattgaggggaaaaaaagaggatgaaaaaatgaagagagagaattactgatgtgcttcacacccacacctcctctccaacttcacagtaacagaggcaatgtcactatcttttacctgacaagtgctttaccagggagttgtgcctggcatcgtgggagtggaaaatttttcccttttgcattttgagacttgggtgtgctgctttaagatgccactggtatctaagtaatgtttgtttatactggatatttttctctgtagcctttgtggattggacttataatataaacaatattgttagcagaactgcaggtactctattgctatgtttattttattagttaaaaaactaccagagccctaggacttctgagcacatttagaaaataccagaggcaattttaagactagcattagaaagaaagaaaagaataagaataaaactaagacttgcataccttagaatcctaaccaatgtggtgatttttaaaaattaatgtttcagagactctaaattagggtagttggtttcatcaattacattttttaagttaatataaagtgcttttgtatgtaaattctcttaatagataatttaggtaaaatg

SEQ ID NO: 47897 - DNA, 429 bp, Homo sapiens
tggaaaaaaaggaaatccatgatcctggtccccagtgtttttagacaagcaggcacacaacaggctttctctcccattgccactgagatgaggaatggatcagagctaacttgggcattagtcataaagcagatgcacagattctctctaataagggtgggattacttggaaaagccacctgtctgaagatacaaagacagggtaggcaggtattccaggtgggggatcacaagagtaaagttctgtgagcaagcaagccccaagcatgtttgaggagggtgagccatgtgacatgtcggggtacagaactctaggggctggccaggaccatcccaagaagggccaaatgtcatgccaggaggcttggacatttgtcctgtgcaaagcccagtacttaaccacatttcatgctgaagcacaaaaacctg

SEQ ID NO: 47898 - DNA, 697 bp, Homo sapiens
aacattttcaacaattgatcaatacatgactttcttttaagtgtgcttctgttaaagacgtcttttgtatgtgagtggaaaaactcaaaactgtttttcctctgttctcacaccactacccaagcaagcagtaaattctgcagcagacatccactgggtgtcctccagttcaattttgacactatctgcttggagatagggacagatcccacaggttaaagtcccaatccccaagactacctgctctccccagccaagagtcacatgtctgggtctctggaatttctgaccctctgagtggcttcaagttgggattctcatgactttgggttgcactaatttgctagacaggctcagagaactcagggaaacacatgtattagtttattataaaggatgttataagtctgggcacagtagctcacaactgaaatctcagcaccgtggggaccaaggctggaggattgcttgagcccagaaattcgagaccagcctgggcaatatagtgagaccttgtctctacaaaaagctaaaaaataagccaagtgtggtggcatgcacctgtagtcccagttacttgggagtctgaggtgggaggaaagagcacaggaggcagaggctgcagtgagccaagatagtgctactgtactccagcctggacaacacagagagagaccctgtctcaaccaaaaaaaaa

SEQ ID NO: 47899 - DNA, 717 bp, Homo sapiens
gccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatcca

SEQ ID NO: 47900 - DNA, 461 bp, Homo sapiens
aaaagaatagaatgcagcccaaagcagatggagggaaatgacagtccgcagtcagccaggcctcaccaaagaatacaggccctctgccaggtccctcctaccctggagaaatctgagtcttcaaattgccaactccctggactggtctaagtatttttctgccagcgttggaatccagcctcacaacaattcccctaagcaatttctcagttcctctcacttcctctggttccttctcaacagccataattctttatagaaataagttttgcaaagccttcatgttctgacatgacctagagcctcagactcatgtttaccccatgctgacctcagaacagccgggggaatcagaataaaaaaaaaacaaaaaacaaatcttcactctaataagtaaaactgtctcagagttgaagccagctgcccaacccacttgaaacctttctttgacagctcaaatg

SEQ ID NO: 47901 - DNA, 277 bp, Homo sapiens
aagttggttaaaggtttattattttaaaaatctttttaacagtatggaggtttgaagaatattgtagccttgtattataatacaagaatacttggattgttttattagtagataattaccattacagaaatcaaaagttttgatagcaacagtgaagaagataatttttctagagggttgggagttcaattaatagaatggtttatgctgggcatcataagaagtttatataaattcaaactgtagcctaaatgagggccagcctgtggtttgaatt

SEQ ID NO: 47902 - DNA, 159 bp, Homo sapiens
caaggccacaactttctatgaagcgaatgtacccttccaagggcctaaacactaaacagctcacacaagcattttgcagggaccactgataaacccaatgcctccttgggaaagcagtctcaaactacagaaatttctctcttgagctgcctgttcttt

SEQ ID NO: 47903 - DNA, 513 bp, Homo sapiens
caggcatgtgccacgacaactggctgatttttgttatttttcttagagacggggttttgccacgttactcaggctggtctcgaactcctgaactcaaaccatccactcgtctcggccttccaaagtgctggaattacaggcatgagccaccgtgcccggccaagtacagtacttaaatgctgaaccactttgtggttcacagagagaggaaatcagcaagtacgagggtgaagtttcagccaagtacaaggaaggtttcatcaaggagcaaggccactgggctttgatggatgggtgggatttgctagaggggaagagagtagaggacatatctgtcacagggaataacttaaatgaaggcacagagtggaaataagactggctattcatgggacagtgaggagactggcctggcacacacaggaaatatttgtggagggaatgtaggtgattatagctgaatatgctaggaagaacaaacctaagcagctatgaagaatctttaaaagcaga

SEQ ID NO: 47904 - DNA, 462 bp, Homo sapiens
actttatatatgaattcttgaaataagtgcacgtatgtttcatgcttgcaaattgcatccaattagaatagcttattttaaaagctgttttagagaattcagaagtatagactcataaaatgtcaacttatcccctaatattccttttggtacatttagatttctaggtgctggttttgcttacattcactataaatcttaattgcaaagcatattcaagccaatgatcaatatcaaagaaaactattttttttatcctaaggcccatatgccagaatccccctgtcccccaatctttatgcttcttcctcatatctgcttccaaatcaagaaatgattggaatctgggtgcagtcacctgcaccctgtagtcccagctgttctggaggctgaggcaggaggatcactccttgagcccaggagttcaagttcagactgggcaacatagcaagactttgcctg

SEQ ID NO: 47905 - DNA, 402 bp, Homo sapiens
gcacagacaagacatctacctagacctggagtgggaggacagccaggaagacttcctggaggagagggcaccccagcttgcatttgaaagtcagacagacagggtgtggcaaccaggcagcagtacaggggaacagacaaggctgagacatattcatagttgtcacctactcaacattgccaagccttgttcaaagcacctggaaaggatgatctcatctgtccacgtggcaaccctagaggcaggtccttttactgtccatacgtggcagaggaaggaactgatttagagagaggtgcgggcttgtctaaggggacacagctagtatgtgcaggttctcaggctccatgtgggcttctgtgctctctggctggtacccttgcctcttgtcatgccgcacac

SEQ ID NO: 47906 - DNA, 1102 bp, Homo sapiens
ttgcaacctctgcctcctgggttcaagcgtttctcctgcctcagcctcccgagtagccgagactacaggcgcgtgccaccacccccagcaaattttctgtatttttagtagagacggggtttcgctgtgttagccaggattgtgtcgatctcctgacctcatgatccacctgcctgggcctcccaaagtgctgggattacaggcttgagccaccgcacccggcctctcttcagtgttttgtgatatcaatgtgtgcctaagacatactgaactggaacagtgggaggggtgaacatctgtctttcagaatacgcatgtacagcctggccaatgctggctttcttgagaataccaacaaaagttccactggcaaagagcatttatgaaacctgtccattctgttttaatttagttaccctgggtaggttataagcataacaaatgtgcctttgaacttgtttttgattgcttaagaaagaatcatgagtaaaagtacaaataagatatcctaagccaaatgtggtggctcctgcctgtaatctcagcactttgggaggccaaggcaggtggatcgcttgagcccaggagttcgagaccagcctggataacatagtgaaaccctatctctataaaaataaaaaataaaaaaataaaaaattagctgggcggagtggcttgcagctatggtcccagctactcctcaggaggttcacttgaggtggaggttcacttgagcccgggaggtcaaggctggagtgagctgtgatcatgccactgcactcaatctgagtgacagagtaagacactgtctcaagaagaagaagaaaaaaaggctctcctagctctggaatttcatgggaagttcactgaggctaaaggacttggtgcagcctccaagggacaccctacctgtccatggtggttgggatttggttataaaacaagatgctgatgtgctagctatactaactggttggatgaaaggaagacagtaccttgaaacacccgacataagatcgctgtttctcctctcacctgattctaggttagaaacaaaatctgcattcattttgatttggcttggctatgaaaccaaatgcca

SEQ ID NO: 47907 - DNA, 432 bp, Homo sapiens
aattttaaaacataagactgtagtcttatgtttgtttgttttaacccctaatcctaaccctaagattatagtatatttaaaacactatacttggccaaactgtctgaaatacaaaaatgctaactctatagttaattgaaaaaggcaatagtgtggcttataatattacaagcattttatttaaaaaaaaaattgatatggcttcaagtgacagattgacccctagaaaatacctttttttgttttaagagacaggctctctgtcacccatgctggcgcccagcggctcaatcatagctcactaaagcctcaacctcctgggctcaggcagtcctcctgcctctgcctctcaaagcactcagattacaggtgtgacccactgtaccgacccttagaaaatgctcttacacatgcaatttactgtagacaaat

SEQ ID NO: 47908 - DNA, 554 bp, Homo sapiens
aaagcctccttcttttcttatttccatttaactgtcgcctccttggcgaggctttgcctgagcatcctagataaataagcccctctccaggcattctatgacattatcctgttttattttctttattatacttaatagtatctgaatttacttaatttgtgtatttatctcttctcccaacacacagttgaggaacatttggcttgttcattcatgtagtagggccaggaatgtaatagacaataaatgtgaactcacagatgaactgactccttgttctttcccttccataaatagaattctctgtgtgtgtctataaagcaaacaaagtgttttacactgtagtgttcattctaaaccctctattttagaaacctgtacattgaggcgaaagtcacatggggagagagtagtacaacaacgattaaaaaaccttatcttggccagatgtggtggctcacgcctgtaatcccagcactttgggaggccgagacgggtggatcacctgaggtcagaagttcgagaccagcctggccaaaatggtgaaactccgt

SEQ ID NO: 47909 - DNA, 846 bp, Homo sapiens
tagggagaaagaattatagttaagagtttgtgtaagcagttgtgttctcaggcccaaatcttaaattcacaaaaactaacaaaatttcacttcagtctaactgccaagtctttaatatttctcttcagaattcattttgaagttttttcataacccatatatttaatcatttcatttaggttattaatagaattttcttcttatgataacataccttgtaagcatgaatattttaggtgtcaggagtcattttagatgggcaatgtaaaatttaagtaaatgtgaataatcaaaagttaggccaggccgggtgcagtggctcacgcctgtaatcccagccctttgggaagccaaggtgggtggatcatctgaggtcaagagttccagaccagcctaaccaacatggtgaaaccctgtctctactaaagatatcaaattagctgggcatagtggcacatgcctgtaatcccagctacctgggaggctgaagcaggataatctcttgaacccgggaggcagaggttacagtgagccgagatcgcgccattgcactccagcctggtcaacaagagggaaactcccatcctcaaaaaaacagttaattacatttttcaaaattatagtaatgttttttctgattgcaaaatattacctattttctgttaacaatttaaaagtgtaaagaagaaactgaaaattatatttagcttcactgtataaagataactactcttaaaattccttcactgtttgttttttgttgttttgtgtgtttttttggtggccgaatttccatatatatctgtatttaatttaaaaaatgagaacctaagtatgcattgtagt

SEQ ID NO: 47910 - DNA, 692 bp, Homo sapiens
gagatgtggaggcccaatttaaatagttacagctgctagctcctaaggtctatcttactatctgcaccgtttgcggggagtcagcttaatgatagtaaactgtgctaaatgggtctagaaatatccagttaatctgtttgagatattcggaaactcaatagcttgctgaagtagcaaacttgaatccttatttttattttaaaagggagtaaagggactgtagataagtaaaagatgctctgcactgcgcctctctggtaccagtccctctcgtttaggcagcggccacttcccgcggagctgttcacgccaagtgaccctgccactgcgctgctcccaccaccccatgtccaccccgtcctcggacgcctggtctcagcacatcaccggtattctcttcctcttaccagtaattagtttgagactgtgactcacttctgtccaacaagatgtgaagggaagtcttcctgggaggtttctggaaagcgttctctcacttgtgatagccctgggaagaaatgctccccgggtcctcagagctttgttgtggctggacgcatcttctggaactgcgacagcggaggaggaagccaagagagtgaaccaaaacaaggaagggcggagggcgggggaggcctgcaaaccttacggcttatttccactgacatcagagactcatgttaataagtaac

SEQ ID NO: 47911 - DNA, 1148 bp, Homo sapiens
taagagatagagtttcaccgtgttgcctaggcttgtctcaaactctaggcctcaagtgatcctcctattttggcctcccaaagtgctaggattacaggaatgaatcaccatgcccagctctgccctgtctttagaaaccccactccccttttttttaaggatttgttcttgtttttattttatattttaatgttttgagacaaggtctcactgttgcccaggctggagtatagtggcctgaacacagctcactgcagccttgacctcttgagctcaagtcatcctcctacctcagcctcctgagtagctgggcttacagttgtgtgccactacgcccagttaattttgtttttttgatagcgacagggtcttggccatattgcccagctggtcccaaacttctgggctcaagtagctcgcccaccctggcttcccaaggtgctaggattacagatgtgagccactactcgtcaagaaccctatgtttttccattattcttgtttgaggctctccacaaatggtctccagcttgccttcctggctttgttttttttgataaagacacatattcctctgagttgctttattcaccttttccataccacactttgttccctacttcctttatcttgattcctgtcaattccccttcatctctgttttctagctccagtactctgttggcatcctgcctgactcaggtaccagtccacttttaaagcttttcttgaccacttacgtctatagtgttctttttactgaatccctggggcttgccacagattatcttatagttgtggattttgtatatgtatctttcctaccttaggagggggccttaagggtaagtcccagactgatttacctgtttttccccaaatgttaaccatttgaaagaaagaactaaatggatatttctcaaatggcttttgatagatacatgtacaatacatctgttgtcatacctggttggaaaaaaaaatgcctgtaaattcttcacattgtttgaaatcagtgtgtcagaagctgtaggattgtagaagctttcttaagcaaggccatagtatggctgtcaaatctgttactaagctttagtctccatttctgaaaaacgagagtaatgtgtaatccttaagatcctttcgta

SEQ ID NO: 47912 - DNA, 493 bp, Homo sapiens
gggagactgagtgatagagaagtaacttgctttaagggcatggggcagagctgggatttgaacccaggtagcctagcaccaggctgcatgctctgccaggaggctgtgcttcctctgtagtaaggtggcctgtccctctcaactctttccatcactgggcacaaagctactgcatcagctgtcctccatatttaaaactcaggtatactctttgatgaaactctacctttagagcttctacccacactaccaagtcccaacaataccaaaacactcataagggatctggcccaaagcaaactgttccacattactacttggtagaaaacgaaaagctcctttttgatttttcacactctggacattttagtgtgtcatgacccagtctgataaccttttatgtctcttaagcattttgttgtgtttgtaactttttaccccctaattcattttcactgtcctgcaaagagttggaataaattaaatgtctaac

SEQ ID NO: 47913 - DNA, 448 bp, Homo sapiens
tttaaagaggtagggaataaaatagatctttagggaagaaaaagttgtctgtgaattgtcatactgaaagtaataaagtttattttgcattttatttgagacatgattatatcaggaagattctagtttcatgggtatttttgtataaatgcagtaacatctattagatgctctcaataaataaatatcaatagatattaatattggtgtttatttttagtcctttaaatgttttattcagctatagtttgagtttagattctcaaatatttcagaaagctgctgttccaatttgaagatgtataggtataatattacatcatataattgaagagtaggggactataaccctacatagtgtcatacagaccatcttcagagcagtaataatgatgtaaaagttgaaaacagttaatatttttgcatgatgctattgattgcagttaat

SEQ ID NO: 47914 - DNA, 306 bp, Homo sapiens
ataaattctaatttacacacactcacacacagccaattcagttgtatgatttgaaccatttttctttcttcttgcaccattatttggtctgagtcccgagaaggaaatcttacttgaataacataaatgtttttaaatattattaaattcttaatatcaaatattaaccaagcacagatgcacaatctggacatcttccatgtggaaatatcttcatacaaaaggcatttatttaatttggactatgtttaacattttttttttttgagacagggtctcactcctgctgcccaggatggagcgtag

SEQ ID NO: 47915 - DNA, 681 bp, Homo sapiens
aagtattatgaagtttttctcaaatgcctagtttggagagactatttttacaactaatttagagctttcaagtggatttaaatttgtcttgctttgaagatattttatttcatatcacgctttcagatttcttttagttttgtaaaatttcaagttgctttttcttgaattataaatttatttagtgtgttttggtttttaatcatttcatttattcattcaacccaccaacagaaatgccaagcagtgttctagataccaggagaaatcgggtgatgagacaaagtctcttacattctggtaggagaaagcagacaaataaacagacaaagaaatactgtagttttagataacagtaagtaaaataaagaaaataaaggaggttgtgataagtagggtctgagaggcaggagagcaggggatactcttaaaaataatggtcgaggacagcctctctgaggaggtgacatttgagaagagaccagaatgttcagaagcagccaataatgcaaaaaatctggtggaggagcaccctagaagagggtagttagtgtaagatcttgaagcaagacaagcttggggtgtgcaagaaacatcaagacaagcagtatgtgcagtgagccatgatcctcccactacactccagcctgggtgaaagagtgagaccctgtctccaaaaag

SEQ ID NO: 47916 - DNA, 800 bp, Homo sapiens
tagcatgagtagtacatgtttattaagggcatcatgttaggaggtgtgtgatgccagtttgttctgttattggtgatagtaactttgaccagttggttaagattgcagcttgccttttaaaaaatataggtatatttacacacagtgatttcacatgtcttttaactgtgctgttcaattgttttgaccagtgcacacacccagaagctatgtccttcggcagtaaaagttttacagcacaatatatgtgctctgctctcctcccgcaatcctgctccaagagatcttaagctggaggcaccaggtctgaattccagactcctccccaccacccacacttcacctccaactggagcatgaccacagacccattcagggaggctggcggactcttcatcctggacagtcccttactgtatgtcaagtaggtaattgccagcatgtgtgcgctcctatgtggctgcctgtggggatgcttctcagtgtagagtgggggaccctccatgccttggccaggcttcagctcctttgtagttgggtagacatgaggacagactgagctggggagatcagtggtggcgtttcatctgctcagtgccatctttgtacccctcatccctatggagattggtgtgtctaccaggtggaaccatggggtagagctatccctgccagctttcctggacctggtcacactataccactggactccgggcatcttcagccttggaacccttatgtggctctgatggcttggctttcactgccttgctgggagatctgggctcacgttgcctggt

SEQ ID NO: 47917 - DNA, 1702 bp, Homo sapiens
  misc_feature (305)..(305): n is a, c, g, or t
  misc_feature (365)..(365): n is a, c, g, or t
  misc_feature (367)..(367): n is a, c, g, or t
  misc_feature (493)..(494): n is a, c, g, or t
  misc_feature (600)..(600): n is a, c, g, or t
  misc_feature (791)..(791): n is a, c, g, or t
  misc_feature (855)..(855): n is a, c, g, or t
  misc_feature (860)..(860): n is a, c, g, or t
  misc_feature (909)..(909): n is a, c, g, or t
  misc_feature (935)..(936): n is a, c, g, or t
  misc_feature (1038)..(1038): n is a, c, g, or t
gaatgtgcaggtgtccacctgggcccatatcacatggcccacctgagaacgggtgggcgaggggtcaggagcagtgatgagcatactgatgcttatgctgtttcctgtgtatgccaagagcaacaaaatcctttgtgtctgaccataaagtctcatttcttctgccacatgaaactggcaggctaacttgttagcttgcaagtagggtaagatgtcagaccctttacagttgtttgttttttggagacagggtctcattctgctgcccagactggagtgcagtggcatggtcatggctcactgcngtctcaaacttctgggcttaagtgatccagctacctcagcctccagagcagctgggactncnggcatgcaccaccatgcctggctaattttaaaaaaattatttttgtagagatagggtcttgctatgttgacgaggttggttttgaactcctggcctcaagtgatcctcctacttctgcctgccaanntgctgggattatgggcatgagccaccatatccagccagttcttattgtttaagtaacacattcagttttctagaaatttacttatgaatttacatcaaccttcatnagtagtattggtttgtaatttttttcttccacactatcttcattagattattatggttatgctaatgctacaaggaatttgtaagttttccatctcttcctgtactgaaacagtatatacgatgtgcaaactattcctttaaaatttgcaaagacttagactgagcgtggtggctcacacttgtaatcccngcactttgggaggtggaggtgggaggatcacttgagggctgatggcttgagtccaggagttcangaccngcctgggctacacggtgaaaccctgtgtctactaaaactacaaaaattngctgagcatgctggtgtgtgcctgtnntcccagctacccgggagactgacgaaggagatcacttgaacccgggaggcagagtttgcagtgagccgagataatgccactgcactccagcctgcataacanagtgagaccctgtttaaaaaaaaaaaaaaattgcaaagactagtaaaatggttttcacttagaaactttattggaattaattattttttcaactttttttctattgacaaaagcctatccagatttactacttatcaagttaatcttagctatttatattttctcagaacataagtgaattaaaaaaacttaactgcatataaaattgtcttatcatttaagagtctctcatatctatagttataactcatttctcatttatttgtttttgtgaactctctctctctctttctgtggctctctctctcttttttctggactttccagaatttgccagaacactataatttttagtgtttgctttcattaatctttgcttttatttttgctggtttttttttggcttcaaaagctaacttcatcttttaacttcttaaatttaattcagcttaattattttatgttactcatgctctaataaagcaagcacataaatctgcttttcctactgatagttttagttctatcttgtaagatttgatatgtaatcttctaatcattattattttttgaataatctgtaatcataattgttcttttctttagtccaatagttatttatgtatatgttttctaatttacaaataaacactttcctatttta

SEQ ID NO: 47918 - DNA, 860 bp, Homo sapiens
tcctgcagtaacagaggcagcacctaccccctcacagagagtgtgggcagaataacagagaggagggagctgcggaaaaagcgtctttcaatttgtgcacatccccaagtggcctatgtgtgaaactcatcagaattaacacagcaaaagctttaagaactgagctatgctgtggaataccactcgggtttctgggtatccactggtctctgggtagcacacaggcagagcagaccaagataacgctgaatttgaaaccaaactgacattcaaactcacagaccacagaagtgagtcatgatgtgcattctgaattgaagcaggttgaatgcatgctaaagtagaaaatataaaaaggaatcagagtttcataatacccaaagtactgataatattgaatattacttgtcatgtcagaaaacagaaaaagtcaaccagaatgagaacaggcaatcaacagatgccaataccaagatggtactgatgttgggattgtctggcaaggatttttaaagcagctatcattaaaaaacaaacaaaaacacttttaacaagaaactatgaacactcaaaaaacaaaggttcaataaataaaagatacaaagaaaccccagccgggtgcggtggctcatgcctgtaatcccagcattttgggagcccaaggtgggcggatcacctgaggtcaggagtttgagaccagcctgaccaacatggagaaaccccgtctgtgctaaaaatacaaaattagctgggcgtggtggcgtgcacctgtaatcccagcttcttgggaggctgaggcaggagaatcgcttaaacccgggaggcggaggttgtggtgagtcaagattgtgccattgcac

SEQ ID NO: 47919 - DNA, 241 bp, Homo sapiens
tgggagaagaggacatatttggataggctttctggaatagaccctccagctatttctacaagacaaaattatataagactacagagagctagaagtgctttaaaacactaaataaatttacactaaacactaacttcagcttaatgctctaaactggcacttgctaaagatgaatttttctgcttactgatggatattgtagactgtcataatagtttttacaaacgaggagttagaaatc

SEQ ID NO: 47920 - DNA, 528 bp, Homo sapiens
gaaatcttggggtcatccttcctttctgtcaccttctatcttcagtcaccaagtctttctgtctgttagcagctctaaaatctgacccttccttctccttcttactgcctctgctttagtttcttactctataaaatggagataatatatcactgtgtagatgccataatacaaatagcaagctcttatggcactaataattttttaatacatgttaaccatatgaataggtcttattattattatgtccattttatggatggagaggttaagtaatgtgttcaaactgctccagctagcagctggtagagttgagggtttgaatataggctgaacatctggctcctgaatctgtcctctgcattgtactgagaaccctgtatcgtaccgaggtacgtcatctgtgttcttctgtactctcctattttgggctaaaccaggtcaaactcctatcttagtgtctttgaaatgctcaaacctcacgttgtgcacatgtaccctaggacttaaagtataattaaaaaaaaa

SEQ ID NO: 47921 - DNA, 441 bp, Homo sapiens
aaatagatgcatctgggctgtgttggaagaagatacactcaaaactgtctaaggagacagaagcccatctgtgtataaaagcccaaattgggttgctttttcttttattgttgtaaaaatccattctgttcaaatcccagctaatgaaaatgtgcatctgtaaataaaaaataaatcaagggaatgtaataatcctgcagctgctgtccacttaactttccttttaaaaaataactcaattttctggtctgaatgttcttgctatttagcaatgtgatggcaatttaagagggaaaaaataagtattgaaatctatttatgtataacaaccttgacaataaatgcagctatgcaataaatatatagtaatttgcttttgtaattgtgtggatacttgaggtccaggatctgaccccagaaatccactacctggctgcttac

SEQ ID NO: 47922 - DNA, 281 bp, Homo sapiens
ccatgaaacaatattctctgaccacaatgcagtgatgacgaaaaataactgaaaaacattccaggtgtagaaattaaaacacaccagcctggccaatgtggtgaaaacctatctctactgaaaatacaaaaatgagccgggcatggtggcgtgagcctgtaatcccagctactcaggaggctgaggcgggagaattgctggaacccaggagacagtggctgcagtgaggtgagatcgtcccactgcactccagcctgggcaacagagtgagactccgtctc

SEQ ID NO: 47923 - DNA, 1257 bp, Homo sapiens
gtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggcta

SEQ ID NO: 47924 - DNA, 1475 bp, Homo sapiens
gtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctgaaaa

SEQ ID NO: 47925 - DNA, 796 bp, Homo sapiens
actagttctagatcgcgagcggcgccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaaaaaaaaaaaaaaaaaaaaaaaaaaaaaagaacacaacaaaaaagaaaaacaaaaaaagaaagaaaataaacagcaaaaaacaaaaaaaaaaggaaacaaaaagaaccaaaaaaaaacaaacccataaaaacaaacaaagcaacatgaaacgaaacaacacaaacgacggcgccccgcctacgctaaacacccacctcgcagcgccggggccacacctatggaacggaacccttcttcccgtagacgccgacctccttcggcgagacactctcccaatcaaaagtgtcagcacgcccccgcgccaacatcatacacagctgtggacagggcgacaataccggcgtgtcgcatcacgtatgtacgcctagagacagctcgccctacccagatttgtcggctctcaaattcagcactcagcaacattcccgacacatctataatacacggaggccgcggatagcaaaaaacacagcaattctgtcgcgttcatgtcgatggcaccccaccaacgacctattagtcatccgggtagcagtcagatctacgtcagctttacgatcaaccatctctactcccccgccgcactatcacatcaccgagccgtagcata

SEQ ID NO: 47926 - DNA, 375 bp, Homo sapiens
aacaatccactggcccaaagaatcagccagaggccttaacactgagttccctgtcaacttgtccacagcagcagcagccgaggcccagccaacaagccactgagccacccctggctctgcctgtcccggtccctgccatcaagctgcaccccacagccaccctctgcagacaggcatttccagataccaaagccagttcctgtaattcctcggcaaactgcaaagcattttgatagctccacacacacccccactgtcacccggcaccctgagccaggagggctccctgggaggagggtcagcccgggccccctcagagaggttcgcagctggcatgtgatcaggccctggggactctgagggacccagcctggc

SEQ ID NO: 47927 - DNA, 652 bp, Homo sapiens
agtagccaaaatcccctttttagaacatattgcatgtcactgaatcttagactccattgattacaagctacaccataattttctgcatgccaaaaagaggaaaaaagaagaaactctgccagttatgtgacatgccattgattctaaaatatgttccaatttgaaagactaaaatgtggagaaaatgtgtaccttagaatagatgaaatacagcaaataagatcatgtcactctcctgctcaaaactgtccaatggcttcatatcatagtcgtaataaaattctaaattcttacatggtttataaggccgtgaatgatttagctctcccctatttctcttagaatatctttaaggaaaaatgacttgaggccaggtgtggtggcttatacctgtaatccctgcactttaggaggccaaggcaagagggttacttgatcccagaagtttgagaccagcctgggcaacatatcaagatcccatctgtaaaaaaaaaaattttaaattagctggatgtagtggtgtgcacctgtagtcccagctcctcaagaggctgaggtaggaggctcacttgagcctgggacattgaggctattgagccgtgattgtgtcactgcacttcaacctgggcaacagagaaagactgtgtctcca

SEQ ID NO: 47928 - DNA, 261 bp, Homo sapiens
ttcaggtaggcaaacctgtagggcaggttggaacctgcagagaagcctgcagtgagggtggggtctgcactgagccttctcaaagggatgtgttttacaggcttctctcatatacacaatcagggaataccttctggattcttgggtgttttgttgttgttgagacagagtctcactccacacccaggctggactgcagtggcatgatcttggctaactgcaacctctgcctcccaggttcaagcaattctcattcttcag

SEQ ID NO: 47929 - DNA, 998 bp, Homo sapiens
tgggaggtgtgcacatatgtgggtccagtgttctttacaaaggccccctgtgtggcatctgtcgtacttcttatttgttcagcatatcccttggcttgtgatggaagatacacaatctgtacctttgtctgaaggagataccagctcctgagtggccttttacatcatccttaggtggggatagttaacttaaaaaaaaaaaaaaccggcgagggagaaaaggccgtcttagccatagttggcagcccctagccctttagcctaaggaagtctacagagactacggcacttgggtgcagacttttaatgaacccatcttttgttgtttttgtccattgcactgtctgtgtgtaacacacacgtcccggttctcgcccctgatcctgatggttccaaggagcgtggatggatactttcaagaccaaccagactactacgtggcttagtgtagatatggcgataaaacacttgtgctttggaaaacgtaaaaatcccgaacttagatcttgaccagtaagtgaagaggaactgaattttaactatttgctgaaaaatctatcattttggaagcattaaaaaaaattaaactgtaaactgagtgcacacatcttaaccctaaatacatacacacatacacacaaccagccacaaaatagtgttatttccttaaatgccaaacactgtctagttctagaagtgaaaaggaccttcttgtcttttcagaagtgtgtgttttgagtatgtaatgagattacctttctgtggctttggagaattaatttcagcgctttattgtcagatcttctctgtaagaaatgtgatagggatttcccattcaatctggaactaagaattcagattgacacttgagctttgtacctcagatagcgtttttcctcatctcctgttatatatcaagcagctgagattggtttttaaaaaagtgaagattgaattgtcttcacacatttattgtgaacttgcagaaaatggaaagg

SEQ ID NO: 47930 - DNA, 481 bp, Homo sapiens
tccaaacatgcctggtgtggtggctcacacctgtaatcctagcactctgggaggctgaggcaggaagatcacttgagctcaggaattcgaggccagccctggacaacataatgagaccctgtctttacaaaaaagtcaaaaatcagctgggtgtgttggcctgagcctgtggtcccaactactcgggaggatggcttgagcccaagaggcggaggttgcagtgacccatgatcattcactgcactccagcctgggcaacacaaaaatcctgtctcaaacaaacaaaaaatctcagttcacacatgactacttctacctctactttaaggaatttttttcctccccaggtagattttggattttaattatctaagtaatatataggcttatactttagcctttgtattaggaattttctttttacatcattttctgaatcttaaacccatactgtataagttaaacaccttttgaaatgaaa

SEQ ID NO: 47931 - DNA, 372 bp, Homo sapiens
ttcttcatctctgcatggtctggtagctcagtgcctggcacttggtagacattcattaaatgaatgaatgtatgcatcagtgaatgaatgaataaacaaacaaatgaacaattctcctgtcacgcaggatctgctgaagatggcggctgtaagttcacagagcactgcctaactttggttcatattgttcctctcttctcctacctgtattttgctcacctcaataccagcccacactgttttcctggactgtgattctttcagtgatcacagagtctgtgctgcataatttaagtgtccctattccttgcagctgcttcctgtgtgctagtcatgtaaacgcccttcttaaatgattgcatccctcacaat

SEQ ID NO: 47932 - DNA, 595 bp, Homo sapiens
gagccagcagtaagcccggggcctggaggggtggcattgaggaggaggatgatgacagccatcacagagaactggacacaagtcaggcatgggcctgggaccatttattatcttctgaggcacagggtgattaggtaacttgtccaaattcacacagctaataattggcaaagttcagatttgaacccaagccttctgactttagggtcccttctgagctcaccctcttatcttacaaatgaaaattaaggctcggaatgtgagctgcctagagtggtcacagagctctttggcggcagaggtgagaatagaaggccaggtgtggtggctcacacctgtaatcccagcactttgggaggctgaggtgggagggtcacttgatcccaggagtttgagactggcttgggcaacatagcaagaccccatctctacaaaagattaagaaaattaggcctggtgatgcatgcctgcaagcccagcggctcaggaggccgaggcaggaggattgcctgagcctagaaggtgaggctacagtgagctgtgatcacgccactgtgctccagcctcggtgcaagccctgcctcaaaaaaaaaaa

SEQ ID NO: 47933 - DNA, 640 bp, Homo sapiens
gagttcaagaccagcctggccaacatggcaaaaccctgtctctactaaaaatgcaaaaattagctggaaatcgcttgaacctgggaggcgggggctgctgtgagccgaggtcattccactgcactccagcctaggcaacagagcaagtctccacctcaaaaagaaaaaaaatttaaataaataaataaacatagctacacaatgagaagactggacctagggactgggtaggatatagcagggcaaagtctccacgtgaagtccaaaccctagggcagctgcacctccccaccccactggccctccaccacacggacactgactcacagcagagccacgctcctagagacacttggggtgttaagcatctgtgggtgccacaaacattcaaatagtaaaatcaaccagggcagtcgagactggacatttctatgtcgatgtctgtttatacctgagcaaagaaatactaagtggccgtgtccctagccagatcaggagtcctggtttttctttctttttccattcccccctcaacatttgcttatgaaaaatgtcaaacatacaaaaaggttgagaggattattcagtgacatccctaaacctaccacctggttttgtttggtacggagggagggggagg

SEQ ID NO: 47934 - DNA, 329 bp, Homo sapiens
gaggagattgagacatagaaagagcaacaacttgcccaagtttatgcaggttttgaagcaaggtattctctagatccagtgcttttcacaatgctaaatccagaaggtggacgcatatatcatttggggaggggaaaacagtaatgttggaaaagtaaattaaagcttaactttgcaggcttctgaatgccaagctaagtattttgaataatttttccccaagcaatatggaatcaatgaaaactcgaccagaggaatagcttgtacaaaagagtgttttaagataattaacttaatagcagtatatggaatcatctgcgtctgaatag

SEQ ID NO: 47935 - DNA, 400 bp, Homo sapiens
ataaatgcaagaagaagaacattacaaaatcccaactatagtgcttagaaaccctttgacagcaactgatagcaactcaaatataattagtatatacaaaaaagataatttatggattcatatgtctgggagtattcctggatttctggatccaaggattcaaacaatgttcccagtttttctttttttttttttttttctttctgtccctatctctcagcttgcttgtctttcctctgcttaattcttggctgggtcagggggtcaaagaacagcttgcttaacaaccccaaggcaaatagagcttcttttctgaaaaccagcaggaaagtcacggaaaggactctcttgggaaggatggtgggggtcatgtggaatgacttactgaagaaggggatga

SEQ ID NO: 47936 - DNA, 328 bp, Homo sapiens
gttactcttcatatggctagaagagattctgaatctgtttgatacacatttgttaagggcttgggaatttggcccagtgtttccttgtttgcttgggttctcataggtttcacatccagagttgagagacccagtactgagaaacccaggtctgggtgaagagtaggttacagagatgagcaaaagagataacctctgagctccttcagtatcctcatgtgataccaatcctaagaatgagaagtttagagtagtcaagtcgtacgggatagtgatggttaaatgttatcctggcgggcagttgtgggggccaacctgagaaagctaa

SEQ ID NO: 47937 - DNA, 338 bp, Homo sapiens
ttgggacattttctccaaagaatcctaaatattctgaggaaaactggaagaacaagtaacataaaaaacaaacttgtggaaatagtttttaaattataaattgtaggccctaaataattcagaaaaaagagagcattgattaaaccccatgtttcctttctcacgtagtatgtcactgatcgtctggttcagatttctaggcccctactcaattctttcaaatttccatttgtttcttagttaaggctgttttccccctttcaggaattgattgacatgaacattttgtccactacagatgccctgtttccccaaaactaaccttcacacctccatta

SEQ ID NO: 47938 - DNA, 413 bp, Homo sapiens
agcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggatacttttcagatgaggatgattgtgaaag

SEQ ID NO: 47939 - DNA, 379 bp, Homo sapiens
atttgtataacatggtatatttgttttaatttgaatttctttaaataactgtgaaggtaaacatttatagttgtttattccccatgtatgaattatctacttgtgtcttatgttcatatatttggtgttttgaaattttatacgtgagaattagatatcccttataattgttagaaatcctttaacacatttctgcaattttttcaattatattgttatgtttacagcttattttcattataatgaattttaatatgtatcattgatgatttcttttataacctcttatattttttcaaaattcagaatactgtctctccaaatagctgcttatggacattccagaaataaagaatgtcaccacctccagaaaaaaaaa

SEQ ID NO: 47940 - DNA, 365 bp, Homo sapiens
ttcactccctgttctccaaaatgtattgagaaccttacccatcccagatgatgagagtttacaatctgtgacttctgttcttagttgatagtatttctttatgttgcccaaagtaacagattcaacaaaaaatgtactgggagatccccatgtaccaggtactgagccaagtgatctcacatacctgagctcattacatcatttatttctcataccaaccctgcgagagcagttattatccccatattatgaatgagaaaactgagcctccactatgttaaatattttgtctagttgcaaggcaggatgcaaggctaagctttggctttctttgggatgtaccttaacgaggtaatcaattggtc

SEQ ID NO: 47941 - DNA, 419 bp, Homo sapiens
agagtgggtggggagttccaaatcctgtgtgtttagcttcaaggcccacgctgcttccttgaccacaggttgtcagatcaagtgagaaaatgaatgtagcacactgtagaagtcaagtattagaattcttcgctgggcgcgatggcttatgcctgtaatcctgcactttgggaggctgaggcaggtggatcacctgaggtcaggagttcgagaccagactgatcaacatggtgaaaccccggtctctactaaaaatacaaaattagccaggagtggtggtgggcgcctgtaatcaatcccagctactcaggaggctgaggcaggagaattgcttgaaccagggaggcagaggttgcaatgagccaagattgtgccattgcactccaccctgagcaatgagagcgaaacttcatctcaaa

SEQ ID NO: 47942 - DNA, 447 bp, Homo sapiens
ttttgtagcctgggaagccatgcatgcagaatggcagaacttacaattgcctacaaaaggagagtacaatgcaacctgtggagccacgccaccaagagaaggtgacagttccgggccttcaaaacaccctaaactggtgaggagtttcagaatgaaacttgttatgatttgaaacactcatcaaagtgaggctttttcaagtaacagttaagacataattaccaaattttacaacggtcccgttagtgtgctgtgagaaaaaaaaggagaatggaagaaaaccttccaagtttatatgtttatggatgtaatagatggatgtggcactttcagagccaggaagagtggctcaggacaagatgagaagagcttccacagccttaaacacagcccttttccaaagtgacttcccttcacacccatccacccccctccaaaaaaaaaaaa

SEQ ID NO: 47943 - DNA, 560 bp, Homo sapiens
gcctgtgaacccttagccaggctggtaatactctggaatgacaagaaaatgcaccttcttagggctgtggttaaattaaacagtaacatatgcaaagctgagcatataagagaagaagcacttctggagaagttgtcaatggacaacgaagatcactgaagctaggaggctggcaacatgctgctggggacgagaccctgggcagatgctgccagaactcagaatgctctgtcctcagagattcacaagcctgagtggggcctgtttctcatttccagtccccaggtgtggtttcgagaagaggcttcaggaagggaaagctgaccagggagatggtttctgaaaggatgtgtctttctggaccagaggaaacaagccacaagctgggtggaagacaagccatacgcctgctttaataaacatccctgaggatgcagagatgaatgagacacgatgtggcactgtcctcaaggtgctctcgaatcggtgttgggggaatgtggtgaaaagaaaagaaagagggaagtcagagacacaggcggctcacacaggaggaggag

SEQ ID NO: 47944 - DNA, 257 bp, Homo sapiens
tcagcaagaagaaagatgagaaaactgtaatagtaaaggcatatgtctcagtatgtgtttgtgtatatagttatctgctttctgtggctgggaaggtcatactactgaatcctatgacagtttatcacaatgagagagctatataaaggattacaaagaattagtgaaaatgtagcattttgttgctttttaaatagaacattttctgaaagtgtgtgtgctgtgttattcactttaaagatggtatccatttttaa

SEQ ID NO: 47945 - DNA, 5895 bp, Homo sapiens
  misc_feature (898)..(898): n is a, c, g, or t
gctgtgcagctgaggcgccgccgtggagccgccttggagccaccgcccccgatcgccttcgccgctgcgttggggaacctggaccgcgcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggntttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgtgtgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatgagtgtttctcatttgatttttttatcgtaaaatatacataacataaaattcaccattttatccgttttaaaatatacacttcagtagtggcattaagtacatttttgtgcgacatcaccactatccatctccaggactttttcggcacctcaaatggaaactctgtacccactaaacaataactcctccccattccacactccagctcctagcaaccactattccactttctgtctctatgaatttgactgtgactgttctaagtacttcatataagcagaatcatacaatatttgttttttgtccttatttcacttagcaaaaagttttcaaggttcgtccatgctgtagcatttatcagaatttcctcccttttaaggctgaataatattccatcatatgtat

SEQ ID NO: 47946 - DNA, 5842 bp, Homo sapiens
  misc_feature (845)..(845): n is a, c, g, or t
gctgtgcagctgaggcgccgccgtggagccgccttggagccaccgcccccgatcgccttcgccgctgcgttggggaacctggaccgcgcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaaggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggntttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgtgtgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatgagtgtttctcatttgatttttttatcgtaaaatatacataacataaaattcaccattttatccgttttaaaatatacacttcagtagtggcattaagtacatttttgtgcgacatcaccactatccatctccaggactttttcggcacctcaaatggaaactctgtacccactaaacaataactcctccccattccacactccagctcctagcaaccactattccactttctgtctctatgaatttgactgtgactgttctaagtacttcatataagcagaatcatacaatatttgttttttgtccttatttcacttagcaaaaagttttcaaggttcgtccatgctgtagcatttatcagaatttcctcccttttaaggctgaataatattccatcatatgtat

SEQ ID NO: 47947 - DNA, 4226 bp, Homo sapiens
  misc_feature (898)..(898): n is a, c, g, or t
  misc_feature (4182)..(4186): n is a, c, g, or t
gctgtgcagctgaggcgccgccgtggagccgccttggagccaccgcccccgatcgccttcgccgctgcgttggggaacctggaccgcgcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggntttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggatgcgaaaggnnnnnccctctcctctcacccccttaaccataaggctacgcctat

SEQ ID NO: 47948 - DNA, 2873 bp, Homo sapiens
gctagctggactgactctcttaatctccaccgctacacaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgtgtgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatgagtgtttctcatttgatttttttatcgtaaaatatacataacataaaattcaccattttatccgttttaaaatatacacttcagtagtggcattaagtacatttttgtgcgacatcaccactatccatctccaggactttttcggcacctcaaatggaaactctgtacccactaaacaataactcctccccattccacactccagctcctagcaaccactattccactttctgtctctatgaatttgactgtgactgttctaagtacttcatataagcagaatcatacaatatttgttttttgtccttatttcacttagcaaaaagttttcaaggttcgtccatgctgtagcatttatcagaatttcctcccttttaaggctgaataatattccatcatatgtat

SEQ ID NO: 47949 - DNA, 2103 bp, Homo sapiens
gctcggtacccccctatttccggtgtcccttaaaaaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgtgtgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatgagtgtttctcatttgatttttttatcgtaaaatatacataacataaaattcaccattttatccgttttaaaatatacacttcagtagtggcattaagtacatttttgtgcgacatcaccactatccatctccaggactttttcggcacctcaaatggaaactctgtacccactaaacaataactcctccccattccacactccagctcctagcaaccactattccactttctgtctctatgaatttgactgtgactgttctaagtacttcatataagcagaatcatacaatatttgttttttgtccttatttcacttagcaaaaagttttcaaggttcgtccatgctgtagcatttatcagaatttcctcccttttaaggctgaataatattccatcatatgtat

SEQ ID NO: 47950 - DNA, 1952 bp, Homo sapiens
tcagccggtaccagatttcacggcagagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgtgtgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatgagtgtttctcatttgatttttttatcgtaaaatatacataacataaaattcaccattttatccgttttaaaatatacacttcagtagtggcattaagtacatttttgtgcgacatcaccactatccatctccaggactttttcggcacctcaaatggaaactctgtacccactaaacaataactcctccccattccacactccagctcctagcaaccactattccactttctgtctctatgaatttgactgtgactgttctaagtacttcatataagcagaatcatacaatatttgttttttgtccttatttcacttagcaaaaagttttcaaggttcgtccatgctgtagcatttatcagaatttcctcccttttaaggctgaataatattccatcatatgtat

SEQ ID NO: 47951 - DNA, 1395 bp, Homo sapiens
  misc_feature (845)..(845): n is a, c, g, or t
gctgtgcagctgaggcgccgccgtggagccgccttggagccaccgcccccgatcgccttcgccgctgcgttggggaacctggaccgcgcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaaggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggntttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggtaattcttcagtgtctcttcaagagttcagtcataaatcgactgcatgctgacattctgtctttgaagctttggatcttaaggatatgaaacaaaaggagaaaatgactcaaatgcatgtgcactttacaataacaaaagcaaaagagaaaaagcttttatctgagcaattcatgtaaggtcatgcaaaatatatttgagctaaaggagaaggcgcatatttgttggcattcagttgagtaaggggtttggttt

SEQ ID NO: 47952 - DNA, 457 bp, Homo sapiens
cacagctagaatggtattagacatagctccctttcaagaaaaatggtcacttggctattaatcaagactgcttgttaccagggttgaatttagaagttgtttcttttcaaatattggttttcctttgatttgccagttggattcctgttactcactaagtccgtctttttttagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattaca

SEQ ID NO: 47953 - DNA, 399 bp, Homo sapiens
tttgaaaacacttgtcatctagtttaatagattagtatagtcgtttctgtacatctttacacatacttaattgggataactattttttatttagtgttgtttatgctcttaatgctaatgaaacacaattgctcttatctctttagggtggaataattaatgatagttctgaattaattggtcctgctgaagctcactcagattccctcattgatacctttcctgagtgtagtacggaaggtaagagattttaatttttttgcatttcaaaggtttggattacagaagactataaatcatatctgcattgcaaaaagacagatgtatataggaatttgagggtatttcactgattctaagatgctttttttctttacattttattatcactgatgttgg

SEQ ID NO: 47954 - DNA, 441 bp, Homo sapiens
taagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggtcaggaacttttgcaaatgcatttctttttattcgctgttgcttccaattaactgagtaggcgttttatcttgtaattagtatcttcatttcctgtctagagcttcattatcagtgcagcaaattcacccccagtaatagcttctagtacttaatgatgccattattcttaatgatactgtttttagctacaaaaggagtaattacagttcacttctgcaga

SEQ ID NO: 47955 - DNA, 374 bp, Homo sapiens
ttgttaataaattattactcgtgtcttttatgtaggttttacttgtaatggacacaaggacagaacagactttcattttaaaagtaagtaaaatttgtagccaggcgcggtgcctataattccagcactttgggagactgagataggcaggtcacctaaggtcaggagttcgagactatcctggccaacatggtgaaaccccgtttctactaaaaatacaaaaattagccgggtataatggtgggcttctataatcccagctacccgggagacttaggcaggagaatcgcttgaacccaggaggcagagattgcagtgaaccaagattgcaccattgcactccagcctgggcaacaagagtgagaccctgtctc

SEQ ID NO: 47956 - DNA, 889 bp, Homo sapiens
gaatgttaatcgtataaggcctatatggcctgatacacccatctcatcttgggaatgggctagccaaaggtaccagaaaactcaaaggtctttggctaaaatcctctgtatcctccagcagtaactttgccattaggactagaaatactcaaagtccaatgagtaggatttcctctcccctagatagtacttggatgggtgctttccatgcttgccaagggcaagaaggcagtgatgaagttcaggaactccataggcaattcacagagaatgaattcatatcaacttccaaacattaacagttacatgatgcctattcctcctccacttcccccaactgggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatcctgacttccgggatgaaattaaagtttatcagcagcactgtggtggggaaaacctttgtgtctacaaaggcaaactacttgaaaaagagacctttcagtttatttccaaaaggcatcatggtttccccttcagtctcacctttttcctgaatgggatgcaggtgaacaggttaagctcctgttgtgaatacaagcatcggaaaggttccaggcttggaggcaaacgaggctacttgggtttgtgtgtgttgagagatcatctccttgctacaagtgcattattgcaatgggccttgacaaaaaaccgtctttgccgaaatctaggaaagaaaagagcactgagaaaggagaggaactgaa

SEQ ID NO: 47957 - DNA, 1982 bp, Homo sapiens
tagttttactttgtagaaataactctctgtaattggactgtattcaacgaaaacttagtaagttgtaattatgcctcaggtatgtttctatgcactgagtgaagagtggagataaaaatagaatttagattttcctttactttttaaataggttgttgcctcttatatatttattctatgatgcaaatgtcactatcctaattcctcagtttatgtttaacagcacacagtggcacttctatgattcaaatacatttgataccctttgaaatcaatcagaatactgcaaaattaatttttctaaaacaatgcttttatcgttatttctcctgttgaatcatcagtacaatttccaaatgaaaacacttaaaataatctcatattacaatctttctctaacagaaccatgatgtaaggacagtgataacaaatatctgacaatgatatgattatttcctcatccatggaaattttccttaataaactaaagggctattttctaaaaagccaaagcattgcttacaagaacttttcatcatgacatggatagacactcagattcatacattcaaagggaagtgtcatgtattccctttcaatccaccctattctattgtgttatcttcctaaattattttctatctacattcttcattctctttcccattgaccctatgttctgtgtgataaaaattgcgtcattggaggcttttgaaggttaagtattatgccccatttcaccattaatcaacatacaacccttctccatattttgtaattcctttcatatacagaaaaaaagatactataatttcttcaaaatgcttgatattaatgatatatgggaaaacaattattttgtgcagcaatcttcagataactgggaaaggccggggaaaaagagagatactggtggttatcaatgacccatgtataaattgtttttattatgtaagctgtcttcacaaatgtcttcttatgtatgatcattagaactgttttatatatatatgtaaaatttccacattatcgagacattactttcagcagtgaagtaatccttttttaactgccacttaatgaattcaataaaatataatttattgtattttgctataataaactattgatgactatttgatgacaatttgcttgccactatgacatttaactggcttatattttgaaatctcatttctgttttctgtggctattttaattttccaccctcaaaatatagatgagtatctttgtagtaggaaaatcataaaaattaacagcttcttccctagttaataactctgcatattgtttttgtgcgtggagcaggggctaaatcaggaggggatttgaggcaacattgaagaccaagcagtatagaataaaagataagagcacaaaatctgtaattataaagcctttttagaattaggtctttgccactttctaaccctgaaaacttgagcaagtcacaacttttctgcgctcaattccttatctgtacaatgtagacaatgagtatttattgcaaagatgaaataatacataaaacaattaaaacagtgcctagcatacttcagtgtgctcatttaatatcagctgccatgaaggtaatcattgtgaaaatcttgaaattttatttatctaaatgggattgaggcatcggatttcttgttccacactgctagctggcttcaaaatgtagaaatatgtcgcaaattactgggaggcaaggaggtttctggcttcattactgttaccattgttcttttgttgtttgctaccaagttaaatttttcacgtgtgtcaagtactcctgcttaaggcattattctcgagtacttaatattttcaacgtgtgtcaatgatcatcattcaatagaaaagcacagcaaggctataaagattggaataacactgcaaatgatacataggttgtaataatccagctattgcaaaaataaagataagttagatactgt

SEQ ID NO: 47958 - DNA, 347 bp, Homo sapiens
tcaaatccttgagaacagagacatcagttaaatcaactttgaatcctcagaatgtagcacacagcagacatgcaaatattttttaaatgaatgaatcaattgtgagacatgagggcttatcttggatcctctatagtcactaaacaggattttaaactggagaatactgtattggccaatggttatctggaaaaccataatcaatgggagtattgtttgtgtttgtggcaggggctggggctggggctggggaagattttcaggaaatggctcagtaattgtaggtgctggagagtctgaaatctgtagagtgggctggcaggctggagacccagggaagagttgat

SEQ ID NO: 47959 - DNA, 740 bp, Homo sapiens
gggatttctattttccaagccagttactaagcaaaatttgtgttatttctcaaatatatgccatggttctgtgtgagtgtgtaaagagctgtaactagctcactttttttttttttgatagaaacataaacagagacgaaaaatgtagggaatgtttcacctgttttactgccattaaataaacctcatctgctaccaagctgttttgggtgacatttgctaaataaatacattttgtggggagacttgaacactgaagcacagagacatgcaaccgatgttctcaggatgaatcctgtttgcttctcagtgcctatacccctaccccagggggaggagtgaagtgggtaaattcaggtttatgttttcacattggtagtttattttccaaacgtacacagctacaacaaaaagtacatgcttttattaccagcgtttcttgtaattctctctctctttctgccccctaacccaattttcccctctccctcactaccttcctccctccctccacaaatacctttattgctttttttttaactggggagtattcactatttctttacacttctatatggatttcacttttaaaaaatctatcagcatgcatatttcgtgcatgtctgaaacctttaaaatattgtttgatcttcatgattatttaaaaatatgtatattgagtatttgcttaaggtaaagccattgctgccatttccaattaaaaaactaataaatgtatt

SEQ ID NO: 47960 - DNA, 543 bp, Homo sapiens
ggacttcttatacttcggggaatgagagagaagagagtaagggactttgcctgggaacccagaacattgtcttctctttcccacatctatctaggctgggtatctaggagtctgcaagatttattgcatacttgggattatggcaccctctagtgctgaaatggctgcagtgaccacagcttagggaactcagcactcagtcccctttgaattctttgaaggccctctgaagaagaatgagtacaagcaaggccagactgtgaagactggaataaataagaaactcttcagtgttcagacatgtacaaatatccacaagtattgagaacattcaagaaaatatgatctcatcaaatggactaaataagctgcccagtgaccagccctggagtgatagagatctatcagatagggaatacctttcagacagggaattcaaaatatctgtcttgaagaagctcaaagaatgtcaagaaaacatgaagaaagaattcagaattttagcagagaaatttaacaaagagattgaaataattaccaaaa

SEQ ID NO: 47961 - DNA, 1252 bp, Homo sapiens
ggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaactgcaactggttctgtgagggctccttcaatggcagtgagaaggagaccatgcagttcctgaacgaccgcctggccagctacctggagaaggtgcgtcagctggagcgggacaacgcggagctggagaacctcatccgggagcggtcacagcagcaggagcccttggtgtgtgccagctaccagtcctacttcaagaccattgaggagctccagcagaagatcctgtgcagcaagtctgagaatgccaggcttgtggtgcagatcgacaatgccaagctggcctcagatgacttcaggaccaaatatgagaccgagctgtccctgcggcagctggtggagtcggacatcaatggcctgcgcaggatcctggatgagctgaccctgtgcaggtctgacctggaggcccaggtggagtccctgaaggaggagctgctgtgcctcaagcagaaccatgagcaggaggttaacaccctgcgctgccagcttggagaccgcctcaacgtggaggtggacgctgctcccactgtggacctgaaccaggtcctgaatgagaccaggagtcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacggtcaatgccctggagatcgagctgcaggcccagcacaacctgcgagactctctggaaaacacgctgacagagagcgaggcccgctacagctcccagctgtcccaggtgcagagactgatcaccaacgtggagtcccagctggcggagatccgcagtgacctggagcggcagaaccaggagtatcaggtgctgctggacgtgcgggcgcggctggagtgtgagatcaacacgtaccggagcctgctggagagcgaggactgcaagctcccctccaacccctgcgccacaaccaatgcatgtgacaagtccactgggccctgtatctctaatccctgtggcctacgtgctcggtgtgggccttgcaacacatttgggtactag

SEQ ID NO: 47962 - DNA, 383 bp, Homo sapiens
ccaggctggagtccaatggcgcaatcttggctcactgcagcctccgcctcccgggtttaagcgattctcatgcctcagcctcctgtgtagctgggattacagacgtgcgccaccatgcccagctgatttttgtatttttactagagacagggtttcaccatgtcagccaggctgatctcgaacttctggcctcatgtgatccatccaccttggcctcccaaagtgctgcgattataggtgtgagccaccgcacccagcctgaatttttatttattagccactctttttttagtgacataaggaactgaatgtagcttattacctcgtttcagtaatgggctcaaatgctaacttagaagatcctcccacaatatatcaattca

SEQ ID NO: 47963 - DNA, 751 bp, Homo sapiens
tgaaggatgaggcgttattccaaaaaagagggaaggacagctggacagcaggagcagtgggagctgcactaaagtttcccttccttcacagactcgtggtgagtgtggccttttagggtcagcagagtctgagcaaacctgagggtctcaacagccagaccctcccaaccctgtactcccatcctttgttgctttgcagcaggagctgagtgattggcacaagaatatgtggtgatgactggtttgttttgtacaaagcctggttgtaagtgccacaggggtttaaaaatgaggtggtgtttgaccttggttttctctggctctaaagccagcactcttgttctctggacagggtcttttaatcacctagtgtatgttcagttttaatgtagatacaagaaatgagacatacatttcctgcccacaaggaatttacagtccagctaggccaaaaggaattggccttagaaagtaatcagtgatgctaggtgcggtggctcttgcctgtaatcccagcactttgtggggctgaggcagaagagtcacttgagctcagcctggacaacatggcaagaccctgtctcttaaaaaaaaaaaaaattggtgtgcacctgtagtcctagcaactcaagaggcagaggtgggaggatcactcgagcccaggaatttgaggctgtggtaagctgattgcaccattgcactccagcctggcagataagggaagactctacctcaaaagaaagaaagaaaa

SEQ ID NO: 47964 - DNA, 436 bp, Homo sapiens
attgactgtaggggagcttgtcttgcagatctaacttggttattgataacatgtagcttttgaaaaaagcaggttatagtaaactagagaggttatgaaagaagtattggacttgtagataatacctggctttgaattcttgctctgtcattgactccttagtaaccttaggcaagtcactttatttttctgggcttcaatttcctcccctataaaacggtgatttcccaagtcctttgccgttttgcaaaccgttaactctgagacaagtgaatgtctccgtggtggtagtagttcacacagtgccgagggttatcattataaataccagattttcagtgtacagaggggttgtaagaaccaagtgtgcacatagggaggaatgtgtgccaacaccagaacaaaccccagcaaaaggctttgagtttgggtgctt

SEQ ID NO: 47965 - DNA, 317 bp, Homo sapiens
acattagccactagctgcgtgtgtctgctggaatttaattaaataaaattgaaagggcagtttctcaatttcaaaggttcaatagcagcacctgctggacacagcaggccacaagttacagaatgcccaccaggtggggtgagcccctctggcgctcccttccacatgctgcctcccagctggggaaactgaggcaggtccctggggagctggaaggtgcacaccaaggacctaactcctgattcagagctccctctgctggacataaagcaggtgacagcacagaggtgacaccaggggccttggagctgtcccta

SEQ ID NO: 47966 - DNA, 593 bp, Homo sapiens
  misc_feature (513)..(513): n is a, c, g, or t
  misc_feature (539)..(539): n is a, c, g, or t
  misc_feature (558)..(558): n is a, c, g, or t
  misc_feature (577)..(577): n is a, c, g, or t
agataaatgatttttcaaacaggtttaatcaaaaggggtgattaacaacagcaacaaagtctacaaatctagatataacttacactgctttttctacttcataagtaaatttaattacagcatctgtaagaaacttaaacaaatatataagaaaaaacaaacaaacaaccccatcaaaaagtgggcaaaagatatgaacaagcacttttcaaaataatttcacataaattatgatatctcaaagataattctctaatatatttttgttgcattctagctgtgattagaaaaaaacagtttattaaagaagtcttgcagtaacagaaaaagttaatctcattattaataaagaaggaaacaaagataaaaattgtgtttctcttcgaaattaagaactagtctcgagttttttttttttttttttctttccttttttgagacggagtctcactctgtcacccaggctacagtgcagtgttgcgatctcagctcactgcaacctctgccttcctngttcaagcgattctctgtccagcctnctgagtagctggattacangcgcatgccaccacgcctngctaatttttgtagct

SEQ ID NO: 47967 - DNA, 1166 bp, Homo sapiens
agataaatgatttttcaaacaggtttaatcaaaaggggtgattaacaacagcaacaaagtctacaaatctagatataacttacactgctttttctacttcataagtaaatttaattacagcatctgtaagaaacttaaacaaatatataagaaaaaacaaacaaacaaccccatcaaaaagtgggcaaaagatatgaacaagcacttttcaaaataatttcacataaattatgatatctcaaagataattctctaatatatttttgttgcattctagctgtgattagaaaaaaacagtttattaaagaagtcttgcagtaacagaaaaagttaatctcattattaataaagaaggaaacaaagataaaaattgtgtttctcttcgaaattaagaactagtcttataaaatctttctttcccaaagatcacttgttccggaatctcaagcatttagaacataagtgagcacaagaaagtaagcaatcaaaagttcagagagccaccagaacaaatttcaataatgtcttagagttgtattttgctttcatccaagttactaaccgtgttatttggaacatatctcatactcatactcatactcctaatcttaagtgtatgttccagttttgtaatatatattagtgaactccctcatcccctcaaatattcatatctttaacttaggattactgccaactctcttaccaagaaatgtttctaaataaataaaaacataattatggaaaaagaagtacaggcatgttttgttagggttgcaaaattttggaaataaataaaatggttcaacagaagggaagggtgacagttaaataaataatgttcattattcttgagaagatatatacttctagtacaaagtaggtatgtctaaatctctaatcaaaattgtatattcagtgtgatcatatcatgtataaaataaaatctgtgactagaaaaaaataagacaagaaaatataccaaaattggtatctctttgtggtaaggatataagtcatattttaaaatttcagggcctggtacggtggctcaagcctgtaatcccagcactttgggaggtcgaggcaggtggattacttgaggtcaggagttccagaccagtctggccaacttggtgaaaccctgtctgtgctaaaaatacaaa

SEQ ID NO: 47968 - DNA, 4571 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcaacaaatatttacctggcagtgtgcctttttgcaacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47969 - DNA, 4385 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatggttccttgttccaatatcaagtgttatctgcaatgacataactgcttacctttttggatttttttttgggagaactccattaattaaggctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47970 - DNA, 4592 bp, Homo sapiens
  misc_feature (4581)..(4581): n is a, c, g, or t
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcaacaaatatttacctggcagtgtgcctttttgcaacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatcaaaaaattaanacaggaagcat

SEQ ID NO: 47971 - DNA, 4409 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47972 - DNA, 3353 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcaacaaatatttacctggcagtgtgcctttttgcaacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagca

SEQ ID NO: 47973 - DNA, 2823 bp, Homo sapiens
cggccgccgcgccggtcacctccaaaacggcatcaacgagagagcgctcgaggccgcctgcagcgagcgcggctccggcggaggtcccgggcaggctccgggcgccaggcgcgagcagagaaggcggagacgcggcctccggttgccaggtgcgcgtctccacgcagaggcccaggtaggaggaggagaagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47974 - DNA, 961 bp, Homo sapiens
cctactactactaaattcgcggccgcgtcgacacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47975 - DNA, 351 bp, Homo sapiens
tacagagagaagggaaattgctggctaagtagaggatggtacagaaggcttaaatagacttttcttccttgatccttaaagtttgaaaaattaacaaaaatgtggtgcgtgctttgacttactatttacacaatggttcttagatcaggtggtatgctcaaatacaatttcagtgaaattagcccctctcctccccttctttctcctctttaggaaagagtgagcttgtaccctttccagatccacagcattgcactgtcaacctttgcatctttaattggcccatttggaggcttctttgctagtggattcaaaagagccttcaaaatcaaggtgtgtgtttagattctt

SEQ ID NO: 47976 - DNA, 283 bp, Homo sapiens
ctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggattt

SEQ ID NO: 47977 - DNA, 4537 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47978 - DNA, 4344 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcaacaaatatttacctggcagtgtgcctttttgcaacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatcttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47979 - DNA, 4478 bp, Homo sapiens
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaagtgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatca

SEQ ID NO: 47980 - DNA, 2597 bp, Homo sapiens
  misc_feature (2561)..(2561): n is a, c, g, or t
gcgcgagacctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcaacaaatatttacctggcagtgtgcctttttgcaacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaagtgncagaaacagaccgggatcctctagatcacctcgcac

SEQ ID NO: 47981 - DNA, 296 bp, Homo sapiens
tcccatgcacaaaggagcgagctgcatttggacgggatgggctaccattgcagcatctttccaaactgtggggtgagatagagccactctatctccagtgacactactctgaatgactacagagaggggtccaggaaacaaaaagagcaggtgtctacacccactagggccaggggaccactcccctcatggttacccagcacatcactgagatctttggagccatacccaagtcagaattttagagctggaaagaatctcagtttagctcagcccattaccattttgcagataaa

SEQ ID NO: 47982 - DNA, 428 bp, Homo sapiens
ggagatattgaggcaaaatagctacatgttacttgaaaaatatgaaacagttctacctgttaggaatgtcaaactgagtcctgtagagaactttaactctccttttcttcctacgtttccatttttgttttatattaaccaacttaaggccatctttttttttttttttttgagacagggtctcattctgtctcccaggctggagtgcaaaggcactatcttgactcactgcaacctctgcctcctgggttcaagtgattctccagcctcaacctcccgagtagctgggactacagtcgcctaccaccatgctgagctaagttttgtatttttagtagagacagggtttcaccatgtaggccaggctggtcttgaactcctggtctcaagtgatctacctacctcagcctcccaaagtgctgggatta

SEQ ID NO: 47983 - DNA, 412 bp, Homo sapiens
ctgtcttttaatgagggttgataactatgtgtgtgttcaaagtagataaaggatacaaagcaactacttcaagttattcaaaaagctcaaccagaaaaaacaactaataattgcatgttttccccccaaatgtactcagctagatctttctaagctcttaattcacgtttcacactcaattgatgttatgcaaagtatgtttttaaacatgatccaggaatatcaaatacagctttacacaactcatataattcccatatttatgtaagtatacaaataagcaacatgaactgccagatgctttgggaagaaaattaccagaaaaaaatttgttgttaagtcttccacatctaattgaaacatcagttccagtgagtatttggagaagcaccaatccaacagcttaacataa

SEQ ID NO: 47984 - DNA, 476 bp, Homo sapiens
tatagtgttcattacatgccaggttcaacttggagcattttacacgtattaatttaatcgtcacatcaaccctatgaggtaggactgttattccaaagagggatcatacagctggaagcggcagagcctaaattcaaacctggttagctagcttctattatagaaacctcattttgtctgaatgcccaggggagattagcctcctgaggattgataaaccaaggtcccaagagcccaaggtgtaaataaaatggcaattggttgatttatactggggtgactgaactacttacgtgagttgcccagggcaccctggagtaattctttaagggtggtattccaggcaatctgagttgtattgggaaagcaactgatggaaaaacagaccctctgcttcctgttatgaggacattttttttttttttttgcagaggcaataggaagttgaagcctccacttttgacctcattggagca

SEQ ID NO: 47985 - DNA, 156 bp, Homo sapiens
atctcttgacctgaatgcaatgcagccttaaacctggaagtgggcactggggcccaaaaagggagagctccaggagaaaccctctaggtttctgttacagagctgggtaggaactcctaacgctcagagaaagtacagaagtcctcagagtttttt

SEQ ID NO: 47986 - DNA, 528 bp, Homo sapiens
tttcttaaatggacatttaattgtacatatttatggggtacataatgatgtttcagtacaaataatgtatagtgatgagataaggataattaaatatttttaaatatcagtttcaactcttctagtcctcatgtaccacatccctggagcccgatcccgtgtgtcacctccctcacttctccctcttccaggttaggttcatcatgaaaacagaggacattgggtacgaggtcccctcaacttttcgtgctacctacttgctttcacatttgccagcatccacctttcttctatctcaacagcactgggctttcctcctccataagctcatacccttcacctgagtgtttgaatcccattcccttcctgagtctttaaggagtcctcctcctgtgtcctgtgtcttcagatgggcctctgcacgctctctgccttatagacacttgcttgaacttctcatttaaaacaaaaacattaggaacaaaaccttttcactccctggatcccttcagtcttctagctaccacc

SEQ ID NO: 47987 - DNA, 249 bp, Homo sapiens
ttttttggtttacgtctttagtatctgagctaccatgttaaacaaactttaaggaagtattcaaacaagaaaaaaaataatttcttcatttagtcacacatacacgcaccagaagcacaaaaaaaccaataatcgtacaaggacttctcaaattcttccttatatattgtgtaagaattaccaaatagtaaaatctggaacattcacttttaattttccaagcaaacaagctaatacacaggaaagcaa

SEQ ID NO: 47988 - DNA, 349 bp, Homo sapiens
gtagacagctccagctctatcacaggttctccaaggaagcaggacaacaggcagaggcagcacctcctccctgctggggagaaatggtgtggaaaacctcaactgctgctaagatggacacaccaatgaagtttgttttaaaagtcctatttgagtgtggaatttttgtgacaactttaccttttcactttgaaattatttccaacctaaataaaaatgtcaggccgggcccagtggctcactcctgtaatcttagcactttgggaggtcgaggcaggtggatcacctgaggccaggagttcaagaccagcctggccaatgtagcgaaaccccatctctactaaaaatg

SEQ ID NO: 47989 - DNA, 536 bp, Homo sapiens
aaactttattttttagagcgcttttaggttcacagcaaaattgaacagaaggtagacagatttcctatatatcccctgcctccacacatgcatatagcctcccccattatcaacatctccgaccaaagtggtacatttgttacaattgatgtgctgctcattttctcattcattccaatatgaactgaatacctactaggtgtttttgtgaacaaatggatattagaaagaaaatgcaactcatccctaaagttaataaatactccccaaatcaaacaaaacctaaactgagggaacagaccacctgaaacaaagaagatcaactgtctttttctttgcaaagtctgctctaacagcatgtgacatccatttgaggcttccagccaatcagaaaatcatcaaaacaagatgcaatgtttccaaatcccagccaaagctcatgaaattaagctggtgaaagcaatgccacaaatttaatgttgggcatactaaattttgacacctaaagatgtaagagactagaatgttaaaaacat

SEQ ID NO: 47990 - DNA, 932 bp, Homo sapiens
atggtaaaaatagtagggactgcgggagagagaaagagtagtgtcccctgacaagtactagaatgacataggtgccaccattaaacgaaactagctaggatggttactttcgattaacactttgctactcaagagtgtggtctgcggcatcaccaggagcttgttagaagtggagatctcagacctacctcagatttactgaatcagaatcgttttttttttttttaacaaactcttcagcaggtttagatgtagctttgtttggaggaagtgtgagattcgttttaggatttctcaaggagttccagccttcaatcagtgaccatggggatctggcaggagggcttgaatttctagctgattcttctattctgtcttaccctcctgtcttccatcatttctgcattgctaatctctatccctggagaaatctatggaactgctggttattactgtagaaagtaacatagttgccaatagtacgactttgtggatgtcacagtcaaaactcaactgcctggctggcacagtggctcacctgtaatcccagcactttgggaagacaaggcggcgggcagggggatcctttgagctcaggagttcgggactagcctgggcaacatagcaagaccctgtctctataaaaaagaaaaaaaaatctcaactgcttgacaggctttttattcacttccctttgtataatgcctcctgtagtaccttttttcccctccaaatctccgtttcccccatcctaacctcctcacagtgttagaaatgcaaattactcttaatttctctgtccacttcatatcatattacaatatgaaatctgtcagtttctctttttactttagaaattttgtcttcatccatcttcattcatttctatttatggagtatataacctcattgcctatgaagaacccttccgt

SEQ ID NO: 47991 - DNA, 367 bp, Homo sapiens
ccgtgaagaaggcggcccgggtcatcatagaaaagtactacacgcgcctgggcaacatagcaagaccctgtctctataaaaaagaaaaaaaaatctcaactgcttgacaggctttttattcacttccctttgtataatgcctcctgtagtaccttttttcccctccaaatctccgtttcccccatcctaacctcctcacagtgttagaaatgcaaattactcttaatttctctgtccacttcatatcatattacaatatgaaatctgtcagtttctctttttactttagaaattttgtcttcatccatcttcattcatttctatttatggagtatataacctcattgcctatgaagaacccttccgt

SEQ ID NO: 47992 - DNA, 159 bp, Homo sapiens
cctctctgcattccagagttaggaaagttctgtggttcatcataaatccattttcttttcttcacacctttaaaatgaggcttcttcactggctggacatcattcattgaagagggtcctctctgcagcttgcatactgatattctcagtagcgtttca

SEQ ID NO: 47993 - DNA, 826 bp, Homo sapiens
gaatttggggttatacaagtgacagaattcttgagtctcagttgattataatataatgaggggacagtgccaggtctttcacgtctccaggtgggaaggggacaagttgcacgatggctgtcctcatctgtgcctggttgtgtgagaattagaaacaacgtttgtaacagtggtacctagtctttgtgaccgtggtcctctttttgatattaatatttttgcagactagttggcataaacaagttggctctctgtactcacattacaaccactgaggtataacactatctcttggagtccttagaagcacctcgctctgttcagctggcctctcagccttgtgtggctgtttcagaactgttgatcatctgtcaagtcatcccagagatcatctagatcttgagtccatttcttgcatgttccagaacacaagaaaacatttgtggctatagcttcatattctatcatgcctttcatccctttctcccgataatacatgaacccggttacagcagaaatgcattccatgcatttgcaacactctggaaggagccagtggttcttgtgtggctttaccaggccagtcgagaatcactgggctggtgcatgagaaaccttcagtaagtggctgctgtcttcatgcacccatggaatgccgaggtgttggttttcttcaataacctgctcctcagggcagtgtttcctaattgctggagaatgacccaagagttgatgaaataatatgaaaagtactgtgtttgctgtaagatggacaagtattggtgatataggccaccccactcccaccctccattctttgtcttga

SEQ ID NO: 47994 - DNA, 497 bp, Homo sapiens
tcgtcttttcttgttcttgctgttctcttttcttctttgcagatttcctcactttgagggagtctagggatcttctttctgagtattcctgaaataatattatcacttacttccatacacagacttctttctttcccactcctatgaggttaacactgaggattagaaaaggcttccagcatttgctgttttcccttttctgaattgtaagtgctatttaggacctataaactacctacctgctatagtaaacaatattccagccaagcgtggtggctcacacctgtaatctcaatactttgggaggctaaggtgggaggatcgcctgaggccagacattcaagaccagcctggacaaacaaagcgagaccctgtctctacaaaaaattttaaaagctgagcatgatggcctgaacctgtagtttcagctactctagaggatcgcttgagtccaaagtgattgaggctgcagtgagctatgatcgcactgctgcgct

SEQ ID NO: 47995 - DNA, 223 bp, Homo sapiens
ctttgtcctgaggtcaatgcccaaacattattttataattttagaagaaaaattttagatgcaatgatcttgtggaaagacccaagcaaagtgtcctgatggtcagcatcttatcacttctcaagtattgtaggagatagactctttatgttccctggggaagccaatttgttccaacagctgcattacaaatagaaattcaaaaagaagtatttgcaattat

SEQ ID NO: 47996 - DNA, 592 bp, Homo sapiens
tagcacctaaactggtacctaagaaaacttgacacatacagaaaaaaccctgcattagtaactctatgaaggaaaatatgtatacagtttactcaaagttatcatgaattaggcatctaaacattaatcttaatattctagaaaagagattatcacatgatttgttaacagaaagctcttcttttgaaaacacacatggaacccgaacataaaagacaattaaagcataagtaggtcccatggagtcaatgcttagccgccttatccctcaaacctttatctcattgcacatgcacgagacatctttagaaaagccactgacttaggccactggtttctaaacttggctgtgctaaaatcagaatcagtaccattagctttttagtaatagattcacaggctgcctaacacaacaaagtaaattagaatctctcgggatacaatctaccattctgtattatttaaaatgtccccagtgggcaggtgcagtggctcacgtctgtaatcccagcactttgaggcgggcagatcgcttgaggtcaggagttcgagactagtatgaccaacatggcaaaaccccatctctactaaa

SEQ ID NO: 47997 - DNA, 304 bp, Homo sapiens
ccatgggcttctgagagcaagaaagaggaattttggtttctgtaactgcagtttccattctctcatggcctctcatttgtttcttgtgcccatgagtttgcctgttagagataaggtgtgtttcttgtcctcaagctcatgcaaatgggtttctgtttcttacaatcattgttcccagatatggatggtgactgatgctctactaaatgctgaaaaaaggcagagtggaagcacagaaaagcgggcttctctgaggaggtgacgttagagcccagttggaaggcaggagtaaatgtgcaccatg

SEQ ID NO: 47998 - DNA, 336 bp, Homo sapiens
  misc_feature (224)..(224): n is a, c, g, or t
  misc_feature (270)..(270): n is a, c, g, or t
  misc_feature (310)..(310): n is a, c, g, or t
ggtgaattttttttagatttccataataaaaagttttaaaagtgtaatatttaagtctttaattgaaaaacatttttctttctccccaaaactatagctttaagtagtctgaaaaaatttagtataatacttttctaaattaaaactaattttaggccaggcatggtagctcacatctgtaatcctggcactttggcctgctggggattacagggcgtgacacncggcatggcagccttatcctggcttttttaatatggaattgtaccntcggggtaacccaaataggatagttgggaaaggcatcctnttttttagggaggggctctggggcct

SEQ ID NO: 47999 - DNA, 392 bp, Homo sapiens
tcatgatgtgtgcgccattggttacacccctcttcttgaagctttctctgtctggaagttcttgccaccgtgttctcccgacttccctcctctctcaggctgttccctggctgacacgtgcctgctcccccatgtgggccacagtgttggggtcctccaggcgtcaccctcagtgctctgctcccctcttaccctcacacctcacacctgagtagcttcactcagctccttgctccacctaactcccaaaccccacatgttcgactgttgtttttttttaagagacaaattctcactgggtgtggtggctcacacctgtaatcccagcactttgggaggctgaggcaggaggatcacttgagcccaggagttcaagaccagcctgggcaacg

SEQ ID NO: 48000 - DNA, 1235 bp, Homo sapiens
  misc_feature (19)..(19): n is a, c, g, or t
  misc_feature (22)..(22): n is a, c, g, or t
acatcgctaggtcgaggcnggntgggcagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggaggtggctaatctcaggactgggaag

SEQ ID NO: 48001 - DNA, 968 bp, Homo sapiens
aaggtatagtttctgattatggggtagaaatgtgctatgtctgtcatttcagccttatgaattgcccagaataagctagatcacctttaaggccatgtggttagggaaacttgggcacagaatttacattttcaacttggtgataagatgggtttaaggtaagaatcaaataggagaaagccttagctgttccagcggcccatgtttaaaagaatgtgcttctttttccaagtatttctgccgcttgcatgcactgagcttctttggaaaggagcaccatgcaggcatattttccagacaggaccggatttgctcgttactcagaggtgtgtgcattctttgcttttaggatatttaattagcatcttttaatagtgatattacggtgtcttaaaagtttatgcatttgaaaagaaaagaacttactccttgccaggtctcaacctatcatggttatctttgcagctgagctgcgttggttttgaggctcacatatggtaaaagtggttggaaatctggaaatattgctgtgtatctgcaaagcagcttgatatagtggaaaaggtattaggtcattaatcatgagatttggattctagccccttagctgctgcctgccaggcctggagacctttgttctcttctttaaactgctgctttctcatcagaaaatgaagttcctctccataccacctctctgaagggctgtgaagctcgaagtggcagcttaaaaaactgcccatctcaggaggtgtcttaagaaggaggacataccgctggctcctgcctttctcacttagccaggtctgatacctgtgttgttttcactgtggccattttaggatttttcaaaggctttcagaaagcaacatgctaccgtaccccttatacaccaaaactggttttcattttggaatataaaagtgagatttctccaccagtacaataaagttgttacaagtggttac

SEQ ID NO: 48002 - DNA, 1859 bp, Homo sapiens
agcgggcggcgggggcggaggcggccgctagcgccctgcccggcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggaggtggctaatctcaggactgggaag

SEQ ID NO: 48003 - DNA, 1806 bp, Homo sapiens
gttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtgccacacccccctgtcccagtgcactggggctgtggatcccttcaaagctgagattgcctgtctgtggtctccagcgttaagcacagtcattagctcagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccagtaggtgtttgcggctgttctgggttctcttggcaacatggaaccagtgtcgtagaggacgattaaggacacatgtgttgaatgttgagaaaattatatttatcccacagttaagcaaaggacagcgaagatggaaacagttcattctgagactctgagctgtagcttaacaacaactcctttcttcttgcttggagccacctcaaagctcttagcaactaagttattatactggctatgtaattaatacacttaaaaaaaaccttaatagcttaccaagtactaagatgatttcttaggagcattttttcttaaatagagataggttcttgctctgttgcccaggctggaatgcagtggtgcaatcatagttcactgcagccttgaactcctgggctcaagcaatcctcctgcctcagcctcccaaggagctgggactacaggtgtgcaccaccacacctggctatgtttgatgttgttgttgttttgttttgtttttgttttttggtagagatgagatgtttcccaggctggtctcaaactcctggcctcaagtgatcttcccacctcggcctcccaaagcactggcattacaggtgtgagtcatggcacccagcattaactggattt

SEQ ID NO: 48004 - DNA, 901 bp, Homo sapiens
gttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagttctagccaggcacggtggctcacacctgtaatcctaacacttggaaggctgaggtaggaggactgcttgatcctaggaggcagaggttgcaaggagccgaaattgtgccactgtactccagcctgggcaacatagcaagaccctgtcattcatagttctggaggctgggaagttcaagatcaaagtgccagcagattcagtgtcatgtgaggacgtgcttcctgcttcatagataagaggtacatacacgtttaggagcatcgtgtcttcctggtggatgaattctgttatcattaggtgatcctttgagcacttttaaaaagaatctgttggccgggcgcagtggctcacgcctgtaatcccaggactttggggggccaaggcgggcagatcacgaggttaggagattgagaccatcctggctaacacagtgaaaccctgtctctactacaaatacaaaaaaattagccgggcatggtggcaggcgcctgtagtcccagctactcaggaggctgaggcaggagaatggcgtgaacacaggaggcagagcttgcagtgagccaagatcacgccactgcactccagcctgggcaacaaagtgagaccctgtctcaaaaaataaaataaaataaaataaaaataatctgtttaatagcct

SEQ ID NO: 48005 - DNA, 334 bp, Homo sapiens
tcagcatgactttcctcttccaaggtgaagagttggggggcatccagagaacaaccgtaatcacttcctccttcaccttcttactgccaggctgaagctcagggccctgtctgctctgtggactcaacagtttgtggcaagacaagctcagaactgagaagctgtcaccacaggtaaatagaaggtttaatttactgtttccagatggaaatatttaagtgttttcagtgtttacttctgttgcactacagaccagcaatctgggggttattactttgtgatgcaaggttagatacgttttcagactgaaagtaaaatacatgtgcatggattc

SEQ ID NO: 48006 - DNA, 2003 bp, Homo sapiens
gttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggaggtggctaatctcaggactgggaag

SEQ ID NO: 48007 - DNA, 2103 bp, Homo sapiens
gttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtgccacacccccctgtcccagtgcactggggctgtggatcccttcaaagctgagattgcctgtctgtggtctccagcgttaagcacagtcattagctcagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggaggtggctaatctcaggactgggaag

SEQ ID NO: 48008 - DNA, 611 bp, Homo sapiens
gttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagccccttagctgctgcctgccaggcctggagacctttgttctcttctttaaactgctgctttctcatcagaaaatgaagttcctctccataccacctctctgaagggctgtgaagctcgaagtggcagcttaaaaaactgcccatctcaggaggtgtcttaagaaggaggacataccgctggctcctgcctttctcacttagccaggtctgatacctgtgttgttttcactgtggccattttaggatttttcaaaggctttcagaaagcaacatgctaccgtaccccttatacaccaaaactggttttcattttggaatataaaagtgagatttctccaccagtacaataaagttgttacaagtggttac

SEQ ID NO: 48009 - DNA, 1051 bp, Homo sapiens
tcttgagtcctctgaggcactgagcttggtgatttggacgcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggaggtggctaatctcaggactgggaag

SEQ ID NO: 48010 - DNA, 753 bp, Homo sapiens
ggagcagaataatctgcagctaggggaaggccaggctgggtctcagggtgagagttacagaaggatatgaaataatcggggaagaggcaagttacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagctgtcctcaggcggcgtgctgtggtggcccatccttgcagtggcttcactggctgcacccctcagcaaggcctctggaacactgtgagggcagcacacccacccaacagcgtgggtaaaaaacggtctagctatggccttgccgcacgtggtgatcgctaacttaattttgcagcaaatttaatctgctctgtattggtattaattagaaatgttcaaaagctggtaataagggcagtgcagaatgggtccttcaggccaatttctggttctgggtatttgaagctcatatccctgcaaataacaggaagccactcacctgattcttttaactttgcgtcctggttatatgt

SEQ ID NO: 48011 - DNA, 460 bp, Homo sapiens
ggagcagaataatctgcagctaggggaaggccaggctgggtctcagggtgagagttacagaaggatatgaaataatcggggaagaggcaagttacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagcacgggtcgcccgaaacctccccctccctccgcaagacgagcacgtacacaagtgtata

SEQ ID NO: 48012 - DNA, 579 bp, Homo sapiens
cttcaatccagaatgattgctaaagctattccagcacctagagtcaaataaaaatatcccgaggtgggaaggaaaacatttgtttagggaaacattaaaaacaggagagtgtgtgccttggagccagagcccagagccctgctgatgtcccggggcagaaatagcccgtttcatcatcggctctggacgaccgccgcccgcattcctcgattacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagcacgggtcgcccgaaacctccccctccctccgcaagacgagcacgtacacaagtgtata

SEQ ID NO: 48013 - DNA, 795 bp, Homo sapiens
ggattagatgttgcatttggttgtttccttagtcttccttactctttcttggtctttcataaccttgacttttctgaagagtactgggcagctattttgtattgtagaatgcccctcagtttgaattttttggttatctcttcatgactgaataagcatttttgttaagaatattatggaagtgatgatgttgtgtgcttctcagagcatatcacccttctttgtttgtaaccatcataacttggtcttccttccaaatggatgtgaaacttgagccaatgttgaccctgagactatgtctgggggcaccgtaggtgcttatgaatgcaaatgtgggaattgagattacatggctataataagattgccctccggatggcctaggatatgcctacattattatatattaattttaaaaatcatcataaaaagaaaaaaagaaatagtttctaaatctcagacagaccactggggaaaatgtccctggacttcagttaggaaagctttggataactttacccattttaacacctcacttagcagagactgtgccatcttggtaagacttgggagttccctgccttgaactgattatttagagggggtattccctgctatggtctatgcactccaactattatatgcggattttgaatttagagtaacctcattctgttttaggattttcttagattaatagaaatgaaactactcaacatttttcttcacaaagttcatcctttattctttcctaactgttcctgtttctagatcttatcttcttaaaaaaaaaaa

SEQ ID NO: 48014 - DNA, 457 bp, Homo sapiens
aggtcaccattatccatttaatggtcttataactaaatagaatgactatgaaattaaataatgcaaacttaaagctgttggaaatttaccttattttgagccttgagaggaatgtggctgtgtggcctgagttatgtagcatgcaactgcaacttctgctttttcctgtaaatgatcaggaaaggccttgtggcaccagacataagaccccctgaaagtatcatccctcctgatggaatggtaaagcaatctttcttggaacatagcaagtagtaaccgatcaaattgctataacgtgtgtactgaccttatgtggaaaatgctgcaaccctgtttactgcctatgtaagtgaaatcttaacttccccattttggaatgctgactccagtcattaggtgtctgtatttcctgagtggttaccctcaagctttgtgctcaaataaactctatacttaa

SEQ ID NO: 48015 - DNA, 400 bp, Homo sapiens
aagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtaggagaaccaacccagaagtaccgaggagttgttataatggttccaa

SEQ ID NO: 48016 - DNA, 785 bp, Homo sapiens
taaaaaacagactgtggattctccagaggagggaccatgtgttatttatctgcatatctccagcacctagcatgatgcctggcacttaatagggactcaagaaatgtgttctgaactatttttgttgttagcttaaaagaggtagacttgggtggaaggataaataaggtagtatgcaattattcacttgggaaaccccagaggcaaaaaaagaaaagtatgaatagggtcaagaagggttcctttacatgtatagacaatagctacacaatggactgtttcagggacattagggctattcaaggcccatccgttgaccttttgagatcacccttacgaagggcaattaccatgtgctcccacaaagtgcatcttcttcccgccaggaaggaccaaattctaagctgtataagtcattggtctcaccctatcccagtgcctccatgttatcaccttcagtgccctccactcttgggcacagaccctgttggtcccttggcatattctactctgtttcccaccagagaagggaaaatcccggaaggtggtgcccttcaatcagaagtaaaaatggctgcatctctcagggcaaccagtgcctgggcctggtattcctgagcccacagcagggaggccattagccccggtcccaagaatccctgcaaccagcatccctggcatttagccttccatccctggcacttaaccccctggccccataagaagggacatttcaaatagtttttcttggagccatggagggttcaaaagaattcttgaacatt

SEQ ID NO: 48017 - DNA, 323 bp, Homo sapiens
tctattctgagttaccagaaaaagggtgaatgaacaccaaacaggtgtagaacaccacatctaaaacaaccaaaactcatatccactaattcaatctatttggtgagtgcttcccatgtgccaggattaggctaaccctttctacgaatgaagattaaataacatacatataaagcacttggcccaggctgggtatatagtagctgcttggtaaatggcagctactggagactaggtaggttctattattatctccatttcacagaaggggaaacttggttaaaagagattaagtcatttgtctcaggccacacagctttgag

SEQ ID NO: 48018 - DNA, 422 bp, Homo sapiens
gttacattcttagacaagctactcacgctctcaagacctcagtctcctcaacttaagatgggaaaacaaactcgctggactactgcaaagatacaactaactaggtaatgtctacatctaatgttgcctgcatagaatgattgttcatcttacctaagtcatattccgctggcatataagtgtcattattagctctcccctcgaaatacatcaggtgcactggatgctatctcaaatgttaagtcaactcagtaacaaggtattcaagaaatggtccaatggaacattagagtaataagccctccccagtgaaaaactctctgcctttcctcttaatgaacaactgcttggggaaaccatagaaaatcttgctggacatttgacagtgtttttttttgttttttgttttttgtttttcttgc

SEQ ID NO: 48019 - DNA, 403 bp, Homo sapiens
cacctgcttcccaccccccacaattaattgaattatggccacagggattaagtgtatgactttacaacgacactgcttggacttgaatacctagctttgcccacttactgaatatgtgataatccagcaaattgccttaatgattcacccatttccctcatttataaaatggaggtaatgataggaatgttatggttgctaaatgaattagaacagtgtcggacacataatatcagctgctctcaattacactattgtcttttctactatctttagtttttttttttttacttctataaattggctttttaaaaattattttcccataatttgtctgaagcttggagaaggaaaagagattgatacctactgttaattcatcagtctttgtttaaaaaaaaaa

SEQ ID NO: 48020 - DNA, 309 bp, Homo sapiens
cttcagtggaaaagagggttgggaggatgggatgtgtctttcctggtattactgtgacccactccccatgttctgcttgtcaagcaatctggaagaattcttgctcttccccaccaagtgttgggcaatcttctagaatactacctcttaagatattctgagtccaaatctcccaagattttctcccaaatctctttatggtgaggatctggggaaaacaaaatcccatcctatttcaagttctgaatagaatacaattccattttatcttgccctcaattggattctcatcctaatttctttcccagc

SEQ ID NO: 48021 - DNA, 423 bp, Homo sapiens
cacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctgga

SEQ ID NO: 48022 - DNA, 690 bp, Homo sapiens
cagaagtgaggcgcccagagaagtgttcacttgtggctcgaagtccaggtgtgatactgcatgaaaaccccccgatttggccatccagagcatggtaatcaagaaacgcctagatgtttccaaaaatggattgggtgtccctccaagtgttcatgaaaaggttgaatttcctcttggtggagagttacagaggagattagcagatcaggctgaattagggcctcactgtgttacccaggctggagtgcagtggtgcaatcacagctcactgcagcctcgacttcgcaggcttaagcacatctcccacctcagtttcccaagtatctgggaccacagggacatggatgaagctggaaaccatcatcctcagcaaactaacacaggaacagaaaaccaaacaccgcatgttctcactcgtaagtgggagttgaacaatgagaacacatggacacagggaggggaacatcacacaccggggcctgtcagggagtggggggctaggggagggagagcattaggacaaacacctaatgcatacggggcttaaaacctagatgatgggttgatgggtgcagcaaaccaccatggcacatgtatacccatgtaacaaacctgcacattctgcacatgtatcctagaatttaaagtaaaattaaaaagtaaataaataaaataaatgtatgaaaataa

SEQ ID NO: 48023 - DNA, 540 bp, Homo sapiens
  misc_feature (461)..(461): n is a, c, g, or t
aaaaaagttaaaaataaataaaaaataaaatagaaaggatgacacttttgcttagtggctaaataggcatcaggacacatggctcagaggcttgacaaatcaggggcaaaatcaccaactgctcagtttccatttaacaagtatgttctgagcaaacatggctcccgcacacaaggactttaagatgataagaaggaacatgtcagttaaatagcaatgtaaggcagtacagtattatagtatatagtaggctgggtgcagtggctcatgccttgtaatcccagcagtttgggaagctgaggtggtcacctgaggtcaggagtttgagaccagcctggccaacatggtgaaaccccgtctctagtaaaaatacaaaaattagctgggcgtggtggcaggtgcctgtaaccgcagctacttgggaagctgaggcaggagaatcgtttgaacccaggaggtgnaggttgcagtgagccgagatcgcgccaccgcactccagcctgggtgacagagtgagactctgtctcaagaaaaaaaaaa

SEQ ID NO: 48024 - DNA, 664 bp, Homo sapiens
aaagaattaatccatttagtcatgggaagcactacttagctttccatagcagctgaattgtggtgcaactttggggctattttaggattttaacctcaaatagaaatgaaagtttatttgtattgatgaacatatgcttttgaataatgagccattgacttgatttcaatgaaagtgaaattgtttttcaattcagttattttatgtttgaacatgaattgaaagctacatctttgtattgctgaaatttaaaaaaaatcaataactttaacattttaacagaaagtgttttaataagcaattattagggtggcttcagaagggtattgtagctttaaaaatttctgacggttattagtacacttttgtactgtgtaaatcagacattggaataaaattacttttattaactaaaattctcctacaataggaaattttactgcattttgacatctagcaggccaaagaaagatgttcagaaagtcttatttctgtctcagaccaataattatcccatattttgtataaaacattctttaaaattgttagtttagatgatcacacaaaagtaacttttccaagggatgtaagttgcctgccactgtactacagtctggcaggttctacagcctggagaaaaatctagtagccttttaaaaaaaaa

SEQ ID NO: 48025 - DNA, 2906 bp, Homo sapiens
  misc_feature (954)..(954): n is a, c, g, or t
  misc_feature (1062)..(1062): n is a, c, g, or t
  misc_feature (2050)..(2050): n is a, c, g, or t
  misc_feature (2140)..(2140): n is a, c, g, or t
  misc_feature (2162)..(2162): n is a, c, g, or t
  misc_feature (2184)..(2184): n is a, c, g, or t
  misc_feature (2257)..(2257): n is a, c, g, or t
cttgatgattgggttagatctggggcgtacatatatatattttgttgttttgttgtttgtttgcaagactattttataggcctattttttatcagaagacatataatatcttttttttttgagtgttcagccattgagccattggtgatcattacctagatccattaattcattaggggttacaaatagtgccattccacctggattcatttatttgttgaaatacttctgtgaggagaaacttgacttcatctgtttggttgattctttctctttattactggttttcagaataaagagttggttatctagcattctccaaagatgaccaatttttttttaatgtcagaaactgcagcctttaaactagttactattttttaatccattgcagttaccattcttattgatgcttaaattgttacatctttggccagtgcaagccttttcaagttggctcccaagtccctttgagacagtctggttattagtctttgatggcttccttactaaccatccttactaggtggtatggcagtaggttccaggggttgttctgtatggattaacttattctcacaagaaccctgtgaaataatacttttgttatccccattttatgggtgaagagaggaacctgagagattgtgacttacctgtatacctctctagaagaagtacagggatgtaaattcaactactcattctagtgctcttttcacttttccaatctgatgcctcttaaaattacttctgtttcatttttttaagtaacttgattgactagctaaaattcatcctactcagtcattgaagattagttattaacttattaaacatgaatttcaaggattgcctaacagtaggatgaagataatagaatagtattctcagaattattctttcaagtattccagtcattcgtcttttctacaatcctgcaaaaatacaaantttgatgaaatatttaagtagttaaggaaagaacagcaaaagtgaagtgtttcctttgtttcttgaaataaagtctctccaactatgagtaactgtagttacatttgntttttttaggaaaatgggaatttgaatctggtgctattttaaaattgaaaggggctcattttgttatgtaatatccatttattgtatatatcgtatgtcaggcattgggtgtacaaggttgaagaccacaatccttgctcatagtcaaggagattctagggtatccacgcagaggaaataacatggcatggtttatggcagagtataatgcctttgggaccagtataactagatcagtgcagtttttttaatgcataaatgacctcagggtcagtggtgagagttggagagatagatatgaattggattattagcgtgccttatatgttttactaaggagctgtcctttaagcaattctaaactgttgtaggattaagtagacaggaaaataatcagatttttagaagtatctcttagagaaatacaaagatagattataggtgggttggaatggaggcagagatctggtgaagctgttgccaaaatctgagcaagatatagtgaagacctgaattaaggcagtgacagttaagaatggagagaaaaaacaggatgtgaatttgagagagatttaacttgtagaatcaataaaagcgaatgactggataaaggtatcttgggcttctgggtggcgtaactgaaggatcccttgctcttcactaagatccagaatactaaagcaagagcagatgtttgtgggtagataatgagtttgaggtgtcccttgggtagttgtatatatttatgaaagccatcagaacgtaagtagtatttaaagtggtagatatggatgatgtaatttaggagacctgattccagagtaagaggagagtactagaacaaaactcttagaaacactaacacttaaatgctgccatctcctatccccaagccaagtaggattttgaccataaattagcgagcagcattgttaggaccactgcttgtcctatctcagtatagagatgcccgtccatgtattcctcntacttattagctcccttttactaatcacagctattcctatctcagttggcaatacctgtgaatcaaggggaaaagtcacatttgactttntgacaaccgccagaagtccttnccaagccaaagcatggattatngaggatccttcagaagactgttggatctttcgacaactgatactttctgctctgttagctctttctgtcttcnctactctaactagcttagattccatggccttccatttctatatctcttgccaatatgctaaacttccttgtttttgtgtcacatttgcctgaaaaaaccccaagcctttgtaagcccaactgtctgtgtagatattgcttgagaaagatcacacattatggaagaggggataatacctctctaaattcttgatcaccaacctcaggtctcaatgttgcctggtaatcctgtgaaatttctactttcaacttattctcccgctttctatagcagtaattttaaacctttattctcttcaaatctcaaatttatctgttcttacttttagcagatggccttgactgctacttccaagacaaaaaagggctgagcgcagtggctcacatctgtaatcccagcactttgggaggctgaggtgggcggatcacctgaggtcagagaccagcctggccaacatggtgaaacccatctccactaaaaatacaaaaattagatgggcgtggtagtgcacacctgtagtcccagttactcgggaggctgagacatgagaattgcttgaaccccataggcagaggttgcagtgagctgagatcgcaccactggactccagcctgggtgacagagcaagactctgtctcaaaaaaaaaaa

SEQ ID NO: 48026 - DNA, 208 bp, Homo sapiens
caaattagaattcaaaaagacatttaaaaagatgtttttgctttgaccaactgacctcatgattatctaacctgagatcatcacttgaatggagtaaacggtcaaggggtctgattcggtgcttgggactggagataaatcattgggatgtggctgtggctctgaagaggtgcctaatctatacgagacagacacataaaccaacaat

SEQ ID NO: 48027 - DNA, 341 bp, Homo sapiens
tttttaaaacatgatagagttaagagaggagtatatgacttggtgcttgtatttcatgcttacagatactgtgagcaattgctaatgagttagcaaattttctaaatcatttttttgatgaatagtcacccacttcttgatacttaaatgactggttttaagttgttcacctcatcagtaaccttgactcctgccatgtaaaatgcacatgctttttcttttagcctggtgatccacggagcaataggccagggaagctcactctgggttgtgtcggggggccagaaaggtttcatatttagtacgtgtctacatgggaatactactcaagccatatggta

SEQ ID NO: 48028 - DNA, 1189 bp, Homo sapiens
cccctctttgctccagaaactgtagcttagatgagagaatgagcctttgtgggacagcattttaaataatagcatacagggagcttgatggatttctttcttggcaaggttttagaactcttttccttcattagatacactctaaagcgtattctaagttgttttcttcattactcagtagttttaaacttgcttttcatttctggatgtttgtatgaaaggaatttcactgaccatagcagagggactttaatcctcatgagttttgtttttggaaataagctatatatatatttcatatattaaaaattaagactcttcatctcacataaggttgagttgctttcttagaatgttaatttcagaaagctagaatatatatccccagaatgcctaatttattgtttgaagaacagaacctatagtaacatcagacctcagaaacttactgtcttgcctttgacttttgaatctttagacagtacacccttttctgtggacctgttgaccccctcctgcagtgtatgctttagttagccatgctgtgccctcttatagtaactagttttctatttccccataactgtagtgagagtcaccctcagtcaaccacacaggctttaaaggtttacagctgtaaccatttcagtgtgtccatgtcacttgttttcattcatttggcaaggatgggtcaaagaaatgacatctaaggtgctagatctgcacttggctctggggagacaaagatgagtaagacacagcccctcccctcatgggctcttgaagatttcactttctggactggtagggggtcagggcacgcatacagacatgacatggccaaagaggcctgtttgaagtgctgcccgtaggagcacagaggaggggtcacgtgccctgctgccaggtagaagttggaaggtggggcaagtgcatttgagagggcagttgagctgggtgttgcattatccatcagacacaccaaagtgttgaggctaatgctgtgtctgtggagtgaacagacagggttggaggttggcaggtagttaagttggcagatatttaggtaaaaaggttggagctaggctgggcaggagtttgggtattgtgatgtcacagccacaggatttgttgcttggtgtgtcaggagtagggatgggagggcgttacgttactggtgaggcaggag

SEQ ID NO: 48029 - DNA, 535 bp, Homo sapiens
gacttttggtgcacttaaagctatgctagcagaagcgtgaaatcacctcccaaaggaagtgggtcctgcctcctcagaaccagaaaagggaaggccataactggagcagtaacctaccgcagccaagtctcagtttcctcatctgtaaagtgtgagagtcaggcaaaattgcctccaagatccttttctgttcgaatattcattgagccaaagaaggttaagaacacatataaattgagaattctgtaattttaagattcatctggaaaaatggcaccctggtaccaaccatcaggactaagagggagagtttgcagtcaaatgaaattaaggttgaacccagttctgccagttccttgctccataacccctagaaaattacttctgtctgagccttgggattctctgtctcttatttatttatttatttttgagacagagtctcgctttgtcgcccaggctggagtgcagaggttgcagtgagccaagattgcgccattgcaatccaacctgggtgacagattgagactctgtc

SEQ ID NO: 48030 - DNA, 405 bp, Homo sapiens
agaaccaggcagtgtgtgtaaagtaggtttcctcatctgtgggtccagtgtcccaattcctgcctcctacaaatgatgttcttggctggcttcaagttcaaaggctttcctcctgtttcatgcatcatcagtctccttcatcacgtgaattttttgaactttgtcatcctatgtgttgtgtcgttctgttttctttatttctttttatttattcatttatttttgagacgaagtcttgctctgtcgcccaggctggagtgcagtggcaccatcttggctcactgcaacctctgcctcctggattcaagtgattctcgtgcctcagcttcctgagtagctgagactacaggtgcatgccgccacgaccggcttttgtatttttagtagaaatggggttttaccctg

SEQ ID NO: 48031 - DNA, 928 bp, Homo sapiens
tcctagcaaagctcacttttaaatctgatctcaacagtcattcaaaggtcagcaacagatgatttagacagtaagattcggattgatacaaatataattgcttatgatggtctaggctcccgataatggcagactagataatttggatcaacagtgagaatgactagaaaacctgcacaaaatacagaaattgtctatatgaaatgctagagcaaatagtaaagcattattggacaggattgggttggagttggggctaagaatggtgggggcctttttctccccttgaggtatttgcccagagattgaggagtaattttgataggctcacagggctgagaaatcacagcttagagtgcaaggatcatgcatggtgaatgtgtctccttgtcttgagttgggaccctgaaagtctgcactattatagtaaagataaattagctagtaagttgttcctcacagggactaaagctcagcaactaaaattggattaaagtgaaatcatatcgctggctcctcaagtttccttgtagaatcaaatgtaaatccttgctagaaagaaaaagaaaacatctaggcctccaacttattcaataatgaattttgcaaaaacagtattcacagaattagaaataaccaggtttgttaggagattagacaatgcgaacatagtgagaccccatccccacaaaaaattagctgggcaaagtggtgtgtgcttgtattcctagctacttgggagactgaggtgggaggattgcttgagcccaggagttcaagggtgcagtgatagtgccactgcactccagcctaagtgacagaatgagaccctgtctttaaaaaagaaagaaagaaaaccctaaaaattacagtaactgaaattaactcagtagaagggcttaagaacagatttggcctagcatgaaac

SEQ ID NO: 48032 - DNA, 1038 bp, Homo sapiens
tcaagggtctatgtctgtcctgtttgctatttcatctgcattgccaaatgcagtggctcctctgggtaggcaacctgaggtggaatcaaattatgaatgcatatgttatctcatgtctataaaataaatgtgttagaatttataaataaagggataggaaaaatgctgattattctgtgtgtcggtgctttgtagtgaaggccagttcacacatgccatttgctatgttggtgtaatttatatgagagtttcatttataacaacgttacctgtcatttatttttctattaagacattatagaaacgtaggactgtacacatccaaatcctgcagaattttcatttcaggttttgaaagttaaaaaaatgtcaccatagaatgaaaattccaagaaaacaagattcatgtacattatcactagacaatttccatttgttttaaacagttttctacagcattagttacatttaacgtttagtataaaagcaattgagcaatttctctttagaagtccatttcattgctttgtagccatagtctgtaggtgaatgaacaagctacatttctccagaattactcattttctttttaaagataaactggtcaatactctccttcctggtatggaggaattttttgtatatgagaagcattcatgaatataatctgccctcttgctttattgtcataggaggggaaattcactgctttcacacccttctgttttggctctttctcccaaaagataagaatctttatttagtatcataccaagaaattggagttcctttagcttcagactatcatcatggcttccaaattgttaggaaatacaagtttgcaagaccccaaggggacttaatattttacatcttactagccatgtcataggttttaagtgcttttaatggggaactgtttcactcatgccatatacctgttttgtttttctaaaaaattaatactgtaagttgtgagcaggtgtcttgtatcactgcgaaacccatgcataataaaaacttgttcttgagctatat

SEQ ID NO: 48033 - DNA, 520 bp, Homo sapiens
  misc_feature (481)..(481): n is a, c, g, or t
  misc_feature (488)..(488): n is a, c, g, or t
  misc_feature (495)..(495): n is a, c, g, or t
  misc_feature (504)..(504): n is a, c, g, or t
  misc_feature (517)..(517): n is a, c, g, or t
agtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgttgtcctaggattgtattcagaaaagattgaacattatgtatgttccttttatttgattatgcatgaatgagataggagaaaacgatggaaggatccacactgatctgttgacttcactagctgggagaccagagacagaatagggtaggaaaagagagctttggggttatatacatttgcattcattggtcttcttatgacaagcatatattgctttcttaatttgaaaccacccaatgaaatggatgatttataataaatacatatttttcccaaagttaaaaaaaaaaaaggagggagggaacccatgttcttcccccnggccccnggccttnggggggggntccccgggggggncca

SEQ ID NO: 48034 - DNA, 318 bp, Homo sapiens
aatttcaagctacctacagtgtacaactgacttaagattcctgactttttaggaagtggctctccggagcagggacaagcctatttcggcattctactgcctatgtctgaagcacaagcaaggttattctctacattctttctttttttttttagagacagggtttcactgcagcctcaaactcctggattcaagcaatcctcccacctcaggcttccaagtagctgggactacaggaccactacacctggctagtttatttattttttgtagagatggggtctcactgtgttgctcaagctggcctcaaactcctgg

SEQ ID NO: 48035 - DNA, 604 bp, Homo sapiens
aaaggagaagagacccaggatatttgcaaatggttctagtgatttccacagtccactggtagttggtgtaaacatcatgtgcacatctgaattcctggatccttttgagaaatcacaggaccttgggacaatatgcatggtgtaggaaagggggcactcacgaatagtgactccgtttagacgagacatttccccctcagttcccaggctctacctatcctgattcattcacctaaggaatcagctttgtccctgtaggaatttggattggcaacttttgaattaaagtctaatccagtggtaacagttcacccatggagtcagataacctggcttcgaatctgggaaccacccttatggctgagtggatttcactctctgcacctcagcttctctacctatgggtagtaatcccggagggatgtggtgaggcataagagaaaatccatataaagcacttaaatgagtgcctaggacagagacaacacaactgttccatcatcgtcatctttccaaagtgccactctgcatgtacctttaacttacacacacaaaaatggggtcatacagtaagtgctgttgatggacagatattgaccagctc

SEQ ID NO: 48036 - DNA, 966 bp, Homo sapiens
ccatctctaaataaataaataaatagtgtaaataaatactgtataaaatgcaaagcactcagaatagccaaaacaattttgaagtcagaaaatagcacttacatgctctgattttaacattacctttaaagctgttgtaaacaagacaatgtggttttggcataaggacagagaaagagaacagagttcagaaatagacccagacttatgctcgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcatggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctgtggtgggaggatcacttgaggccagcagtttgaggttgtatagtatactatggttgattttgcctgtttagtagctgctgcactccagcctggtcaacatagtgagacatcatccaac

SEQ ID NO: 48037 - DNA, 569 bp, Homo sapiens
tttttttttttttttttaagatggtgtgtcccaggcaggagtgcagtagtgcgatcttggctcaccacaatctctgcttcccaggttcaagcgattctcctgcctcagcctcctgagtagctgggattacaggcatgggctaccacacccagctgatttttgtattgttagtagagatgggatttcaccatgttgaccaggctggtctcgaactcctgacctcaagtgatccaccggccttggtctcccaaagtgctggagttacaggtgtgaggcaccgcgcccagcctgagctaccacgcccagcctggtgtattcttaagtcatagtgtaaatggcactaagttttgtcttcagcactctcagcttttcattcttttcaatctctttctccattcaatgatgtctcctctctatgtttaggactctactgtgtttattgtcatgtttggtcaatacactaagaaaaaaagtttttgataaatttatttgacttgaagtatgcatgatcaggatttatgtgaaatctctgttagaactatttgcattttaaagaggaaaaaaagtaa

SEQ ID NO: 48038 - DNA, 341 bp, Homo sapiens
ttcctccgttatattttggcctctgttctttccagatttccctggctttgacttttgggtttaggccttgatgcagaatcccttgtcaggacatttgctctctagtgtcagataggctcctcagtcagcaattccagcgaggactgctcctgatggctgtcaggccagctgatatggtctggggagtggggattgggaggaggaggttgggagttgtgacttcccttcctgtgcccttcaaaaggctgattcacgtgttgcattataatcttgttttatttttggtaaaatttacatttacctactctcaaacttaagaaatagaatgtagggaaaaaaag

SEQ ID NO: 48039 - DNA, 515 bp, Homo sapiens
aaaaaaaaaaaaaaaaaaaaaaaaaacagagggagccaacagagtaaagtgaaagcaagtttactaagaaagtaaagggagaaaagagtgcctactccataggcagagcagctccaagggccactagttggctatttttatgcttatttctttttttaattcatttatttttcaaatggagtattatttcttgatcttatgctaaacaaggggtgggttattcatgaggttttccggaaaggagcagccattcctggaactgagggttccccccgctttcagaccacatagggtaacttccaagtgttgccatggcgtttgtaaactgtcctggcgctggtgggcgtgtcttttagcatgctcatttgttataatgagtgtatcgtgaatagtgaggacaaccagaggtcacttcagttgtcatcttggttttggcgggcttcgatccacttatgtaccgcatcttgtttcagcagcggggtcctcgtgacctgtaccttgcaaaacctgtcctg

SEQ ID NO: 48040 - DNA, 410 bp, Homo sapiens
gaaagtttctatttgcttccaaaataattaccttttgattaatgcctggaattctacagctggtgcttcattcttttagcttaaaacttccatctcttctgcagtggagatctcatcagttatttgtagttcagtatggatggcttttaaatcttttcctgatagattttaatggagggcaaaaagacaccataaggatactatactggggagtagacaagagtgaagaatgtgaggacagcccaaccatttaacacataagagtgaggtctaaagaagaaaggtcaggccaggcacagtaatgcacggctgtgatcccagcactttgggcagccgagatggtttgagaccaacatgggaaacacagtgaaaaataattacgaggaccacggtgaattcttccttctctt

SEQ ID NO: 48041 - DNA, 461 bp, Homo sapiens
  misc_feature (301)..(301): n is a, c, g, or t
  misc_feature (335)..(335): n is a, c, g, or t
  misc_feature (341)..(341): n is a, c, g, or t
  misc_feature (348)..(348): n is a, c, g, or t
  misc_feature (371)..(371): n is a, c, g, or t
  misc_feature (386)..(386): n is a, c, g, or t
  misc_feature (407)..(407): n is a, c, g, or t
  misc_feature (453)..(453): n is a, c, g, or t
actgccctaaaaggaagggcacagtatttctggcctcaccatctgtggttaccacagtccttggttgagacccagtgcatgactggctccaagtttgacacacaacatttccagtggtggtggccacagtattgctacagtcacttcttcctcaactccacacagctcagcagagaaagagagagagagagactccattcattaatatttggaagaaagtaagggaagaggaaaattatctctacctgataatccatggaattcttccagaccttccctaaaaccacaaagggttcattantttcccttaagttctggcaaggggacccacaggnttttanttgaggnttgggggggttgcccccctttantgttagggattacanttttcggggttggacccaaanttttttaggggttccaccaacaccccaggttcccttttttttggantaccctgg

SEQ ID NO: 48042 - DNA, 302 bp, Homo sapiens
gagttctccagattattttcatatatagccagatctgagaactactgacttagaatatcctaaaaaagacaggtggatcatgaggtcaggagatcgagaccatcctggctaacatggtgaaaccccgtctctactaaaaatacaaaaaattagccgggcgtggtggcgggcatctgtagtcccagctactccagaggctgaggcaggagaatggtgtgaacccgggaggcggagcttgcagtgagccgagatcatgccactgcactccagcctgggcgacagagcaagactccgtctcaaaa

SEQ ID NO: 48043 - DNA, 157 bp, Homo sapiens
gtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttg

SEQ ID NO: 48044 - DNA, 430 bp, Homo sapiens
caccatcctgtttttcaccgaggtggtgattcatctcacaaccaaacttctgtaccctttggccagactcttcccatccatcctaagaccaggcctgggaaccaccatggtactctctgcttctgtgagctcaatgttttagattccacatataagtgagcacaggtggcatttgtctttctgcgcctggcttatttcgctcagcataaagtcctccagattcctccaaatgacagaaatgtctttgtctttttaaaggctcaatagtattccattgtgcatctatatcagcacattttatccattcacctgttgttagacatctagaatgattctatatcttgggctactataaataatgctggcagtggaacataggaatgcagacatctcaacacactgagtgcaattcctttggatttgtgccaag

SEQ ID NO: 48045 - DNA, 853 bp, Homo sapiens
gcaaacaccttgagaatggcatttccaaggcccttgggctgtgccagggcaccaacgccagtcgaggaccacgcctttctgagggatgcttggaatctcacagacaggggttcacattccgactctgcttcctagaggctatgtggccttgggcgtgtctggaacctctctgggccacagtttgcttatctgtgaaagagtcatggtagcctctccttatgggtttatggggagcttcggatatggagggtggggcagcacacagggctcaagctgcagctcttagttacctgcttttcctttgcaggtgtcctacgggcctgatggaaaggtggcaggcgaaatgcacctggcctcagcgtcaggggctgtgaatgcagtagcacttgtagctatgaggtcagagtggactaggatggtccttccaccaagaagcctgggccttcctgctcttcgttgtccagctgcagaaactgatctcatccctcagggcttggcacaactgccccttcctcctcacattcccaaatatacctacccctccccaactcaatcctcctcaccagactgtggctccaggatgacagggcagagttggactcacctgtgtctgccaggccagctcaccgtgggggcaggtcccaagaggcctctggatttggaccaacttccagtgtgaccttgaacaaggccttcgcctccctcagcctccgttgcatgaggggttgtgctggcacatctcagagcaggtagcgctacctggtgagttgagggctctgtccatcatctttgtcactgtaatgctgggtaacaaataaacacgaaacaatgagtgctcgtttctcaggtgccg

SEQ ID NO: 48046 - DNA, 639 bp, Homo sapiens
caacattgcattatttgcttatttggtggttaggactgtcatgtcaagtgattggagttttgcttgaatcccttcctagggcgaaatgtctgggcaaaaatggctgctagtgaacctcggatgtttgatatgctgtggttgcagtcactcataacctagtggttttcttctttttgtcttcatcacattctgaaacaaaaaatatgtttctatactaaccagaaaggaagacaggtatagtcgggggtattacctctacatggggaaagggacgaaaagagaagataattattcagaggaacgaaaagcagctaaagcagctggtagcatccattgcagctttaactgtggtgcacaaatgagctccatttacttgattacatcccccttgggtcctcctattcgaattccaagggtatcccatgtggagttcacaggctcactgagtttgctgggcttgtgagcgaaaatggaactgtcagcatattcatttgagcagtgctagaagtcagggtttgtgactttaggaaatggaatcttaggaaatgtggcagtttttgagctctgggaaaggcaccttagacctgtcctgtgagctgtcctatgtctcctccagagaccatggctacttcttaggcc

SEQ ID NO: 48047 - DNA, 777 bp, Homo sapiens
gagctagcaccatgaacttcaataccctgtggtcttatcagtataatatcgtttcatcttcttacactcaaatctcattcctgatgaaaaatttaaatcctctgtagggtgaaatgctggacctaatccttttatcttcaaaaaaaaaaagtatatgaaaatattaaatattttcaccacttctttaaaaagtaaggcagtactcctaactatgcaatcctgcccattcttgctgagatacgcattgcaatgataaagttcaggattagttcccgaaggctcctcccctgcctagtgatagttcatggttccccattgcctatgaaattccttagcagcccctccaagtctacctacatctggtcttaggccactcatgacgggccctttgctgttgctgtcactcacacacagacacacacatgcacacacacgcacacaggcacacatgcaagcacacacacactcacaccatctagccacatcccctttactcatcacccatgcacttaacccacattacctgactttgtctgtgttgctgacttggcctgaatgccctctctgtactttccttttcatctactcctctaagacaaagctctgctaagccttcccctgtcagccagggagagtcacacctcctcagagcaccttccgagacttccatctcagccccaacagaagtgctgggctgagatgaagtgcagaggctgagatgccactgctgcttaattaaagtgaatggcttaattgtttccttatctgaaaaatagg

SEQ ID NO: 48048 - DNA, 214 bp, Homo sapiens
ggctgatgttggacagggacaccagtagaaaggtcactgcagatttcttcccaagagcaaggctcttcggtcaaccccctttcccactttcccagcggatgtgaacttcgtgctcaccaaagcaagaggtttcaaggtagcagcccatggggttgtatctgattggcagaaatgtgtggtttgccctgaattgttttaagatgttttcatgttg

SEQ ID NO: 48049 - DNA, 798 bp, Homo sapiens
cccttcccattctcctctgcgcggcctccatctaagatctcttccccttgtccatagcctagatcgagctccctgtgtgcaccgcgcgctgcccgaggcgcgtaagtgggggaggagagcggcttcccccggggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagaggtgggtaggaaggcggggtacaggaaacttggcaccaacgcgccgggaccccaccgcggtgcggacagccaggtgtccgtggtggcgcttccttggagatgctgcctgcagacaggcgtggggaatctgaagtttgtgttaatagctaaacgaagttgagttgcagggagcgggggacgctgggaagaaatgattgatttaaaaggaatttgacgccgggcatggtggcggcatgcccccatgttccctggaggtcaagcctgcatgagccgagatcgcacccgtaccacgacactccgtcccgggcgacagagcgagaccctgtcacgggggaaaaaataaaaataaaaatttgacgctcactttagctgagtattgagccttgttataacattgagatagaggtctggcgcggcgtctcacacctgtaatcccagaactttggaaggccgatgcgggaggatcgcttgaggccaggagttctacgccagcctggct

SEQ ID NO: 48050 - DNA, 869 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccggtatgcggcctaagtcccctccttt

SEQ ID NO: 48051 - DNA, 3031 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48052 - DNA, 3205 bp, Homo sapiens
cgcggcggccgggggcctccgggcgccttccggggcacgcgggatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48053 - DNA, 2443 bp, Homo sapiens
cgcggcggccgggggcctccgggcgccttccggggcacgcgggatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttg

SEQ ID NO: 48054 - DNA, 3182 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48055 - DNA, 2306 bp, Homo sapiens
cctccactcaggcctccagagccagccagccgtgcgtgtcctcccagcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcagtaaataccttgaaatgcttagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48056 - DNA, 1265 bp, Homo sapiens
ctcgtccgaggattcctgcttcagaaatcgcggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48057 - DNA, 313 bp, Homo sapiens
ccttcctctgggggcactagaccaataagggaaaattgccctaagagagcatgcacgtaacttcagtatggcacatgtgcccctcccagatactagcaagacattgcacatgcagcaattagccaacagcctgccaagggggagggacaagaggaagagacgggaaaagtcagaaaatagcaaatctgcgagtcctgagccagcaatcaggcagagtactgaatttttgagttgcctgcttggttccttacatgtgtgcttttatttgcttcagtgaattcttgtttctgccttaaatctacttctgtctcag

SEQ ID NO: 48058 - DNA, 574 bp, Homo sapiens
atcaatggggaatgcatgttagggtccacttcctctgctgctcctgagaagcaacctgtacaaaagttgtaattctattctctgatattcatgtgtaacaattcttaaccctgtttcacctttttttctcttgcccttaggagttttgggaatgcacttggaaactgtattctggacaaagactacctgagatcactaaataagcttccacgccaggtatatcagacatggatgagtggagtgaagataatgcggcaaactcttgtgtgtcatgggttgagtatttggaggatgcaaggagaaaaagtgaggactcagctctttagagggtcgggaatgttgatttcagatttcgaatgttagagacagcaggaactaatcccaacattttccttttttctaaagtacatcatgtgggccggggaccgtggctcacgcctggaatcccagcactttgggaggtggaggcaggtggatcacaaggtcaggagatcgagaccatcctggctaacacggtgaaaccctgtctctactaaaaatacaaaaaattagccgggcgaggtggtgggcgcct

SEQ ID NO: 48059 - DNA, 2525 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttg

SEQ ID NO: 48060 - DNA, 816 bp, Homo sapiens
cgcggcggccgggggcctccgggcgccttccggggcacgcgggatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagtgaattcttgtttctgccttaaatctacttctgtctcagccaaattcattctcccaagaagacaaggatcgaggactgtggagccaactcagactcgccacggctaacaatgtttcctgggatcgcctcccaaataaactgcttgtacttgaacccttgtctcagagttgactactggaagaaccccagataagacaatctgcgagtagacatgtcagataatgcagttagatatgaatctggaattcagaggagaggctcatgcaatttgcaagtcatcatcaaaaagatgtcatttgttctgtttgtctactgcaggaagacagattaccctaaaatttagtggctgaaaacaactctattttatcgtagcttacaattttgtggattgggaattagagcctgtctcatctgggcaactcttctgttccccatggcatcacctgaggtcactccatggtattcagctaccagacgaactcatctggagtatccaagtattcattcacgctcatatctggcaccttggcagggatgactg

SEQ ID NO: 48061 - DNA, 2916 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggagaatcgcttggacccaggaggtggaggttgcagtgagctgagatcacgccattgcactccagcctgggcaacaagagcaaaactccatctcaaa

SEQ ID NO: 48062 - DNA, 3455 bp, Homo sapiens
cccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcctgtctgccgttttcccactttcgttagtattttttcaatgtttctgtttcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcagtaaataccttgaaatgcttagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48063 - DNA, 3532 bp, Homo sapiens
cccttcccattctcctctgcgcggcctccatctaagatctcttccccttgtccatagcctagatcgagctccctgtgtgcaccgcgcgctgcccgaggcgcgtaagtgggggaggagagcggcttcccccggggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcctgtctgccgttttcccactttcgttagtattttttcaatgtttctgtttcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48064 - DNA, 2096 bp, Homo sapiens
cattgttaaataatgtaaggaaaacatttaaattccaaaaactttcagaaggtactgaagacatggaatttctgagggccagtttttccagtgctttctgtgagaatacttcattatttgctgatgacgcacttttccttgacctctgtagagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccag

SEQ ID NO: 48065 - DNA, 419 bp, Homo sapiens
tccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgac

SEQ ID NO: 48066 - DNA, 713 bp, Homo sapiens
aatgcacttgagaaagcggtagttttgtggggaggcggaaaaagcaactgctttcctgatctgcaacttggctggatgctaagatgtccagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggtcgtgggcgtgggagtctcttgcatggctcaggactgtccactccgtacaccagaggactttgtgtttccattgcttcccaatgaagaattgagggagaaat

SEQ ID NO: 48067 - DNA, 406 bp, Homo sapiens
agaaagggtctcactttgttgctcaggcatgtctcaaactcctggcctcaagtgatcctcctgccttggcctcccaaagtgagccaccaagcccagcctgaattttacttcagaaacaaacaaacaaaaattgatctcagctttgaagagacagcagcagacctggcttattattcctagttcaatatcttaagtgtgtcttgggaagccaaggccctgaaatgattttgaattatcaatagctagtcattttcaaaggctcgtgcttcggttctgacagctttggtttaagctgagagctaattgtgtggggcgtgtaattctgctgagctcatccatttcatccatctccagtgagatgatgctggtgcggcctggggtgggtgggcaggccaaaagctaggat

SEQ ID NO: 48068 - DNA, 525 bp, Homo sapiens
acagggtatgtccacagcttcctctgatagaggagtgaccaggaagcagtttgttttctcattctcatctcttggcagctttcgtcctcttccaagggctcaagccaaggagataatctgttcctgtgcattaagcagttcagccttaactagtttaattgattagctcaaccagtcagtgagtagagatctagccccactgggttgagacacagggcaggtaagttttaacagtgagccaaggaaagaactggaacagtcataaaggaaagggaaggttaaaaaaaggaagcaggtaaggtaaggtggtggctgacacactgccctagccaaagagagtaccatcccggcaccccccgattgctgccatgtgggaagatggactcattctttttagatcttttaagagaagctagaaatctggatttgtatgtgacagttgattcatatataaaacaatagcaacaggctagattttgcaatgcattctagagcacagaatctcagttaacagataagtattag

SEQ ID NO: 48069 - DNA, 719 bp, Homo sapiens
gccttctttgagaccagacacaaagtgtcacaccctctttgcatgcacaatctcccgtaggaggaagggaaccaatcctcagggaacacccaggtgcagagccttactctaaggcacttggcatgtgagctctcttaggacaggggaacttgtttctcctcaaagccactctgagaagtcacttcaccctcttttcagaggaggaaactgagttcagagatttaagcaaattgaccagagtaacagtgactaaatggcagagtaagatttggtccacctaactccaaaagcccatgggggcttatttatgatgcccacactgcctcctgtccagaccataactccttaagagcagggcctgattctctgtccatctgcaaggccaacaagtgctttgctgtagatagaagcatcccccctttgcctctcctaacataggacaggccccacaaggagtagaataaacatttgtttattgcaatcaagacatgctgtggcaccatggtatgaaggtgagcaggagaaatgaagctctgagctcccaacaactcctaggagccaccagggctttagtgagtcccaatgccactggtgcccaattcctttgcccctgactgaaggctgtgaagcctagaactgcaaaaagcaagtattaaaccaaagaaggtgacacagttgaaagcattaagaatgttattaaactgcactgtaatattcaa

SEQ ID NO: 48070 - DNA, 626 bp, Homo sapiens
agggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaa

SEQ ID NO: 48071 - DNA, 702 bp, Homo sapiens
agggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaacaaaaaatcataaataaataaatctaaaataaaaaaaaaaacacaacaacaacacaccaacacccctaccaccaca

SEQ ID NO: 48072 - DNA, 433 bp, Homo sapiens
ttcaaattttttccattgtcctccccacttctctttctctctttttctatcccttctgccctatacaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaa

SEQ ID NO: 48073 - DNA, 414 bp, Homo sapiens
tcaccactcgcctccccccgatctgccatcatacacccgacccccttcggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaa

SEQ ID NO: 48074 - DNA, 845 bp, Homo sapiens
agggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggtaaggagactccctcgacgtctcccggattctccagccctccctaagccttgctcctgccccattggtttggacgtaagggatgctcagtccttctaaagagttttggtgcttttctgggtccctcagctcccgaagctcttgagaaaactatcaaaggctagaatccccttctaactctttttttcccccatgataagcgcagtcggtcacagttcaggtgagttcttacttggcattcaagaaaattacaaaatctgggtagttgtctgggcacgaagcgacaatggcgtctatccctggtgctgaccctgggaagcgctgacccaggtgctgaaacgcagacctctgaagctgctacctcttagcgtacctcacttccaaacgtcgggactagggcaaaggggcaatctaaagaccgaacgccgtatgtttgagattgtgagaagtctcgttcccctacagtttacttggtaaaaatggtaaaacaattctactttgtagctcgtgatgtgaaaattgaattaaactgttggcacacactttatcttaccagaacggtctttatgtgtgtgtgtgtgtgt

SEQ ID NO: 48075 - DNA, 372 bp, Homo sapiens
ggccacggagatcttccaggttcccagggctgctgagcaaggatgaaatgaaggcttgagctgcagagatctgctaacttcaaacccggctatggcaccccgagaacgcaaagctgggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaa

SEQ ID NO: 48076 - DNA, 257 bp, Homo sapiens
atcagtagaaacccaagggacatcattatctgtggcacaggaccaccttcccagaagcagcctcaggtattcaagacttacttaaccacagagccactaacaagttttgcaagaggataggtttattacatacgcttcaattcaagcaattcttttactgatgacaagcagagtaaaataatttttgaatttatggtaatagtcaatgtaggtttccttcgaacagcaactttcagtggcccctttaaagttagctc

SEQ ID NO: 48077 - DNA, 620 bp, Homo sapiens
gcagaggttgcagtgagccaaaatcgtgccactgcattccagcctgggcgagagtgagactctgcctcaaaaaaaaaaaaaaaaaaaaatgcagaagtagaatcatggggtcaaagtacccttgctttaacttctggttcagataattttaacaacttacattgtcaccagcaaggtctttgactatatgagcaagtctcacgttaaagcatttctcatttgacattagctgcccagctttccgctgatacgttgactccaggaggctccttgagttctgagtgtttggctggcctctggtggccccattattattttctgccaggtgaaggtcagtcacctgcacacagatctcatcactcatgatatgctgcagctggaatcaaaggcaagctgttagtgaacacaaaacatttctccattacacagtcaacgttcctttgactcaactcaaaaaaggttttgttttttttttggctggcaattttagaaaattcatcacacaaaccactgtatcattttctcggacaataatcaatccaagattttcaaccatatctgtggtccattgtaaaactttcatctctatttaaaataaaaatcatagagaactcaggtta

SEQ ID NO: 48078 - DNA, 504 bp, Homo sapiens
gcagaggttgcagtgagccaaaatcgtgccactgcattccagcctgggcgagagtgagactctgcctcaaaaaaaaaaaaaaaaaaaaatgcagaagtagaatcatggggtcaaagtacccttgctttaacttctggttcagataattttaacaacttacattgtcaccagcaaggtctttgactatatgagcaagtctcacgttaaagcatttctcatttgacattagctgcccagctttccgctgatacgttgactccaggaggctccttgagttctgagtgtttggctggcctctggtggccccattattattttctgccaggtgaaggtcagtcacctgcacacagatctcatcactcatgatatgctgcagctggaatcaaaggcaagctgttagtgaaccgagattgtgccattgcactacagcctggtcaacagagcaagactctgtctcaaaacaaacaaaaattgtcaatgaccaaacattctaaaagaaatgcc

SEQ ID NO: 48079 - DNA, 596 bp, Homo sapiens
gggaactgaaatcaacaaatgctaaaatgaaactatagaatgacttctacaaaagaagacaaatatatagtttgtcaaaattacttatattaataatgtataacagggcttagagactctgttgtacaattcattttggatgtttgagattaaaaatatccttttagaatttggagaaaatgaaattgttgcatttgagaggagagggagctgcagaacagagcacagtggagagagcatattaaggattctgtatattttatttcacaagtcctttgtaaagtgaatttctcacattaggattaaaacactaatttttctaggaaccaaataagtaccaaactccgaatttacttgcagaacagattacaatttatacctgcttttattcaaaagatggccattttctaatgaagagaatgaattgaggagcaaatttaaaaaattacagcaccgaatttgccatgttttagtcgaatttttatttgattatagttctaagagctgtcaaattacctaaaggaagcaatgagtttctcaataggaaaaaaaaaggaaaaagaaagggaaatgatccaaaaatgctgcaactaaat

SEQ ID NO: 48080 - DNA, 797 bp, Homo sapiens
aactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaatta

SEQ ID NO: 48081 - DNA, 509 bp, Homo sapiens
gatgccgcggcgttactagaggatccccatgatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaatta

SEQ ID NO: 48082 - DNA, 400 bp, Homo sapiens
ggtcaggtcctaacccctggaacagtaagtgttacctaacctggcaatgtattcgcaaatgtgattaagttaacgatcttgggctggaaagattctcttggaaggtcctaaatgtaatcacatagatccttctgagagaggcagagggaaatttgaccgagacatggcaaagaaagtgatgtaaagatagaccagatgtgaaggggctggccttggagactgtggtgatgcagccacaagtcaaggaatgctgcaggcagcaggagctggaaaaggcaagggtcagattgtcccctacagcctctggagataatatattccagaggcactgatttcagacttctagtctccaggactgtggggaaatgaatttttgttgttttaagccaccaattttgtg

SEQ ID NO: 48083 - DNA, 490 bp, Homo sapiens
aacttccagtttttttagcttcgtaaatatagtatacatttcatgcaaatttttgcttgcctgtggatatattaaatttttcctctttggtaaacatgtaaacttgtttctagagcactgattttcaaacctagtaattgtcatttgactgacctcccccatgaattagtgtatgaattgatactgcatttaattttaaagaggaattagtaagaagcctcagatgaatcatagatttattattactatcttaaaacataattattagttcatattagttcataatgtcactgaaggaaaaaatctgttgcctttccatacagtttgactagaattaactctagtactctagcagtacttccaggtgtttagagagcaatgttgctgttagattgcatcatacttagcttatataagaagtcaacttagagtaagaataattcttctgaaaatgtctttgactgagacttgacagttttcatttactgat

SEQ ID NO: 48084 - DNA, 412 bp, Homo sapiens
gggtgacagagcgagactctgtctcaaacaaaaacaaaaacaaaaccaaaacaaatcaatgaagagttaaggttctttgaaaaagggaccaggagtgccttcctttggtcttgctgcagggatacttgccctgctgccttcaaggagtccagtccctgtggttctgagctggtaagtaggaaagagaactaggaaacagctgtaaccacaatttgtcgattcccttaccatatgctgaacattgcttggcgtgctttgtgatcccacctgcaacccactcaagtgatcattgtatctccacttagagctaggaaaatgagggcccacaggggttaatagtttgcccaaggctgtatgcgagtccatggcagagctggggtggtctgaccattgccttatctggcctgggggc

SEQ ID NO: 48085 - DNA, 451 bp, Homo sapiens
tgagatgactttagccccaaattgacagagtaagatcaggtaccccctactcaggccacgcagtgggagctgtcccacaggtgaggccctctcacactgaggcccacagttgctccccaggcttggcaaagcaatggaaccccctgctttcagaatcaggcacagctacagctgcggacggcggagtgccagctgggctctcttgctctttcctggcctcctcccctcaccctcattgttgcctctctgagcttcctgttgagttcaggttctaaggggactggtgctgacttgtgaggatagaatgtagaagagttggccaggtgtggtggctcatgtctgtaatcccagcactttgggagccaaggcaggcggattacctaaggtcaggagttcaagaccagcctggccaacatggtgaaaccctgtctctactaaaaatacaaaaaaa

SEQ ID NO: 48086 - DNA, 463 bp, Homo sapiens
atggggtccctaaccataggcgcccaaaaatgagctgggaacacaagctggccttgctgaacagcactttctatccaagagactgcagaaattgcaggtggaccagctgctgcgggtgaggcacaggaaacagctgtgcttctgaactactgttgtcaggggctgtgcagtgtcccctccaggtgcctgaagtttgtctcctgtgccacacaacagagatacagtcaggggaccatactgccaggtacacagcctccccactcctgacttgcaggcgagcacctaaggacactgactgtctcctttcgcctctgcaggctctggctgccgagtgcacataaatactgtaaaaggagaagctggttcagggaggggaatggtaagaagggttcttttagcaaaatgcaatgttattgatctgtgactgcatttaagacctgaaagctgttgttttaaaaaaaaa

SEQ ID NO: 48087 - DNA, 1802 bp, Homo sapiens
gaatcccacttctcaggccccttccactaggacacactatgagcttaacactgctaagaactcactgaggaatggtgacatttgggggcggctccttcagtgctttgtttggcttcttttttaaattataaatggtggtttgaaagttgttggaggggaaaatcagatgaaatcagggatgtggctgaagcagtcagtgtagcagcgtagcagagaagcagagaagctgtcagcagcctacccaggccccgaaatgggcacagccctgcatttctggcctgaggcttgccgaggtcttaggtgaacttcagctctttctacagcaccccagtctcagcactctttggtggatgtcctgattggctgggagattgttgcttcctgatacagtggtgattacttctgaaagatggggtaataccaacagctatcgtttctgaccatttactgtgcagcatcactgtgcaaagtatttttatacatatcctattgactcctctcaaaactcctgtgaggcaagcaggcaccccagtggcctcatcctagttctggccctggtgacattatgattgcctccattctccatttgataggtacagaaactgaggttcagagaagtgaagtaaattcccccagatcacgcagctagcaaacagctgagcttctatgctcatcctaaggctcggttgaaatggattttttaaaagatgtattttgggctctttactatatagaaaaccgaatctgtttatcactaaggttactaataggccttacatctgtgaaaacttatctgtcagctggccctgaaatgttctgaaatgagtctgagcacaggatgcctgtgacaaccgaatagtttaaaaaaattctccatgggagccgaaaccctattaagacaggtctttatttttgttcctgaatgccacatttagaaacaaaatgtcatatttttgtatatgaatgtcacaagtgacaaagcatatgttgcaacttggcttctaatggttgaaaaaaaaagagaggtaaattatcataatgttgggatcttctcaattatatttgcattttcatttctatcagaagtccattttagcaaaggaatgtaaccttagtcacttgaaactgctgttcccttagaaaacaattgtaaatgtaataagcaaaaaggatagaaaatgcccacaggggaaaaaaatgatccatctggggtcagagccatcgtgtagattgattcattcttcttctagcattcttattcaggaaggaaaacttgaacattttctagattttaggatatttaagatttgcaaggaattgggggaaagggaaaaggaatgaaatttcagtcccactggcagggatcaaatagagattttctcaacttttaaaagaaccgttttacatgtcccaatcacctcatagttcctgagtctctcttctgcataaggcatgtactagttgttaagggaggatacaataaggtcatgattgctttaaaattattcataataaaaacacattttgagacttgattctaaatgttaaacttaaatttgagcaatttaattgcccgttgaataggaatgaaatcccaccggtaggcagttatttcttacaaccactgtgtgtgaaattgaaatcttaagataccatttcaaatattcaccttctctaaggaagttctccccaaagagttgtgaaagataagaaactgacccaaagtcatatgcagtaatctctttttctttacacactcaggtcaaagtagaagcatattattaaaaagaaacgttatgccc

SEQ ID NO: 48088 - DNA, 295 bp, Homo sapiens
tcctgtaaaggatggccattgcattaatggagaagaagatcccttctcaagccttggagaaaacctaactctttctgcctgtaggtttgagagaagagaattgtcatatctttatatatcctcatgaatttttcttttgtaggtacatcccaagcaaataacaatgacttaaatgtgttcaggaaatggcacatatgtgctatatgtttgttatggactcggttggaataaaatgacattaaagaaaatcaaacattaaaaataccttctttataaagatcataagaatcattta

SEQ ID NO: 48089 - DNA, 376 bp, Homo sapiens
actgttaatgccattctcattttgtggcccacttaaaatgtttacgtttgctttgatgtactctggaagagcagcagaactaattttgctcactgataggtggatgtgtttgtggtggggatagttttgaaatcacttgataatgacaatgaactgctgccagggatgggggtttacagattgactgaattaaagcaagcagttaaccttcatgtgtaacagtggtagtgtgtgggctggtaggatagatgagggtgggtggtatcacaagttgatgagttatgaggaaactcctagacacagagaaagactcagacatgaagcttttagggaaactcaactaatgggtctcttgttttgtatttgtagtaaaatg

SEQ ID NO: 48090 - DNA, 737 bp, Homo sapiens
gcacgagggagcagcaagtgcagagtctctgtggtcagagcacacagggctggggctgaggggtgggcagttaacaggacatgcccaggagattgcaggagctagacttgcagagcctttggcccttgtgcacactagaattgtgctctgagcaagggtctgagcacgggccgggcgtaagctaagccccttcaccaggatcgctctagatgctgtgttaaccatagcagggccaggtggaggcaggggaccagtctggaattggaggctggctcctggccaggatgatcgtggacaggatgcgtagcctccctgttgatggttcttcccaggtttttatattcagtgctcacacatctctgagcacataaataagcacttctctgcaatggattcctggaggtgggaagagtatgcagattataaatgttgctgggaactcaaatttctctccagaaataccctattactacaccaccacacacaagagccactcttctccacctgagcaacgctgagtgtgatcagtcctgttaatttttggcaacctgatgggcaagataacctcgtcctttgcattttcctgatgctaatgaggttgagcctctttctacaagttcacaaatcttttggtgtctctctttgtgggaatggcctaggcagtcttcttgcttagtctctctgttcccaaaaggtattaccattcatctttcattgaatttgctagaactgccatt

SEQ ID NO: 48091 - DNA, 385 bp, Homo sapiens
aaaacctcaagagatagcttggagggggtcagctgactctggccatggactaaatgtaaagtcggtgaattttggcctctgtacatttagtgcactctctggggaggtctgctatgtgtctgacagtgtgcaagaaatgggggatatgtccctaggattcctccacttagcgccactgggccctcccactcctgccatctcaagtgaccatcgaccttacccacggctgctgcacctcaccctgctctggtgcacattccccactgcagcatttgcacgtggacagctgttcccgggtggctgtttccagatcttcaccacaggctgcctctggctgttgtgggcaccagagtgggacagggtgttttagacagggcaccactgc

SEQ ID NO: 48092 - DNA, 272 bp, Homo sapiens
catgaatcttttagtcaacctacattggtttctgtgttctatttcttaccagctgtgttaatttgcacaaattatttattctaagtcatcataaaaggggctaaaaatacctacctcacagaattcttgtgaagattttagattaggcatatatggttcatcacagagcctgatactagtgagcactcagttaacatcaactattaattttgttttctagtacttatttacatacatgtaaatttaataaatactattttatcttatgtatg

SEQ ID NO: 48093 - DNA, 628 bp, Homo sapiens
aaatcatcacaatttgacttatctggcatttccctggaaaaactcacacaaagggtactctttttgtgtgtatgtatgttttgttttgttttgttttgagacaagatctcgttctgtcacccatgctggagtgcagtggtgctataacagctcactacagcctccaacctccaggacttaagcaatccttccacctcagcttcctgagtagctgggactacacacagccatgcaccaccacacccagctaatttttgtatttttctgtagagatggtgggggaagggggatctccctatgttgtccaggctggtcttgaactcctgggctcaagtgatccacctacctgagcctcccaaagtgctgggattataagcatgagccacagtgcctgcccctcatccctacttttttttttgcaacagggtctcactctgtcaacccagactggagtgcagtggtgtcataaggactttcttgaccttacttggaaatcacttgcttaaaacagcctcttcacactccccactgcacccacccaccatcactatgtgtgcttgtcaaaaacaatcagaagcaattgtttaaacactataactgcttaaggtggcaataacagaatggggca

SEQ ID NO: 48094 - DNA, 409 bp, Homo sapiens
gaagtttcatgttggctttggaatggtagcaaaagcctttcttggctgagatgatgcttaaaacacacccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatga

SEQ ID NO: 48095 - DNA, 3978 bp, Homo sapiens
aggatcccgatgctctctcttgtgtggggactctgggcttgttgacgctctctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatga

SEQ ID NO: 48096 - DNA, 4166 bp, Homo sapiens
gcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatctggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtgcaacggtgttcagaacttaaggactttgcaggtcttacaaaggcctggcattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagttgcagggcagggtcaggggattcctcagccggaacctctggcacttccccttctctgagttcatcctcccacggtgctctttagcattctgtcttgatcagggtacggttctcttagcccttggctctggctttcaccaggaccctgtttgtttttctttctcagatgtgggatggggaaggacaagaccagcagccctgacccttacgtgatgtctgttcttttactcagtagttcctgcaaaattctgatctctgattgggttcatgtgggtcctctgcttttccctgactgatcactggggtctggggacatagggctgtcatcggccaagcttgagtcctctgttctcccaggagccagggggatgggtccgcccacctagcaagcaggtgctgagagtgaggggagggggctctccagatggaagtccagtgctgtcccttgagtaagtagatgctggacagcctgtagcaaccaatgttctgtgacacggcccccactggcatcagcaactcacttccttgccggtcattggcttggagccatcagagggccctga

SEQ ID NO: 48097 - DNA, 1170 bp, Homo sapiens
cgtggggccgtggggggctcagtgtgatctggactcagcctcttcagcgtggctgctggaggtgttcgtgggtgacggtgcctggtgaagtatcatgtgttagagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatga

SEQ ID NO: 48098 - DNA, 4324 bp, Homo sapiens
gcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatga

SEQ ID NO: 48099 - DNA, 3092 bp, Homo sapiens
gcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatctggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgacgccgcgagtccgaggacggagcccacacctcaacttgcccttttgtcacaaccaggcgtttagagtccactgctccctgatgcattccacctgctcctgcatgggccccagacctcggggctcagcagtgccccacaagccttcctgccagagaggggcggagcag

SEQ ID NO: 48100 - DNA, 1379 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48101 - DNA, 1749 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaaaaaaaaaaaaaaaaaaaaaaaaaaaaaaaaaaaaaaaaaggggggggcgcaaaaatttccccgggggggccaaattttgggggcccccctttttttggaaaagggggccccaaaaggagagcccatataaataaccaacaggccacggggccccgcgcgtaacacaaagccgcgtagccggcggaacccacgctagccggggggaccctggggggaaggaacccacactcgcgcgggcgcccctaggtggccaaccccctaagagataaacgggcctagcgcacatttaaaatccaggcgcatccgcgcgctacccacggccataccggcgccgaaaatggtcaggatatcataggaatcttccgagctc

SEQ ID NO: 48102 - DNA, 811 bp, Homo sapiens
  misc_feature (25)..(25): n is a, c, g, or t
  misc_feature (27)..(27): n is a, c, g, or t
gcttggcggggcatatctcatgttngnggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48103 - DNA, 816 bp, Homo sapiens
  misc_feature (1)..(1): n is a, c, g, or t
  misc_feature (12)..(12): n is a, c, g, or t
  misc_feature (22)..(22): n is a, c, g, or t
  misc_feature (27)..(27): n is a, c, g, or t
ncttgcccaggncttcatcctncatgnatcagggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48104 - DNA, 804 bp, Homo sapiens
cgggttattgctcatgcagtggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48105 - DNA, 1089 bp, Homo sapiens
tttaactcgcggaattatttgtggttttgggctggcccttctaataaagtgtaattggaattttcttaaaaccagtgtatgagaccctgtttggaatgtcacctgtgtggtcttgcccaggtcagtaggcctcaacttggtcctgtcctgtaaaatggggcttttaatacctacttctacggtttgtcaatggagtgctttagtacagggtgaacagagcatgaattcatttgaatccttagaaggctcagtaaatggcattgaatgttaaatactaaccttatgaaagtcagtgaggtagcatagcttcaagtttccctttaacacaatctctgggttcggcctccttggttcaaatcccagctctcttacttgttagtggtggctttccacatagcacttggtctctcagcacctcttaccaaattatttttttaaataaatgatgcatattgtatacaatgtattctcctcaggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48106 - DNA, 742 bp, Homo sapiens
  misc_feature (25)..(25): n is a, c, g, or t
  misc_feature (27)..(27): n is a, c, g, or t
gcttggcggggcatatctcatgttngnggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggtttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48107 - DNA, 1449 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaaaaaaaactggcctctctgcctcaccgggggagttctggggccgttcctttatgggggttacttctgaccc

SEQ ID NO: 48108 - DNA, 1495 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaagattgtgtgtgttttaggaggggggacaaaacgttgaatgaataacaactcatcttttctacaaatgcttcctttgatcaaacaaaaaaaagtttttaaaaaattgatttaagtaa

SEQ ID NO: 48109 - DNA, 818 bp, Homo sapiens
  misc_feature (6)..(6): n is a, c, g, or t
  misc_feature (15)..(15): n is a, c, g, or t
  misc_feature (21)..(21): n is a, c, g, or t
gttctnctgctaggnaatccnctccctagagtgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgtaaaaaa

SEQ ID NO: 48110 - DNA, 1248 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaaatgtgctttcttcctttgatttatgtcgacg

SEQ ID NO: 48111 - DNA, 1044 bp, Homo sapiens
ggcacgagggaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagttgtttgcacgcgccaagcgatccttcctcattcgtgcgcaagatcacggatattcgtaagtatttaac

SEQ ID NO: 48112 - DNA, 411 bp, Homo sapiens
gtgaaacaagtattttggctagtctcctgccagacacatagaaagtattgtgtgagcgtgtgttgagttgtgttaaagggggcaggtctgtgttgtggttgcatacggattgtactgctgggaaggccgccacacctttcctgttgatgtgtctacttaacagtcattgggaaagtagaattgagctgtcaaatcttaaaattttgtggagagatgcttgtttttggactgattttcttttctggtcagctagtaaactagtaggcaactctatgaggttaatgcagccaggaaagaagcctttggaacacagtgccgtccaaaaaaaatgtttgtcttctctttccgtttgctggtgagtggaaacctcacttggttaaacctactcagtgtttgtgcctttgtatctcc

SEQ ID NO: 48113 - DNA, 313 bp, Homo sapiens
atcccagtcattagcgcatggcattgtcttatctcctattgctgtcacttgaccgctgatgtgggagtgactgaaattagctttagcaaaacttggggcatcactctaaagagtgaggttaactgaagcaccgtcctaaggctaggtgttctggaagcatctgtagccaaaatcaagagtatgggaagttccaagccttcctcctagtaagtaagctaagtattgtgggtaaaaacacttatttacagctaataagatgatctcactgacatgtttttattgctaaagtcttttacttgggctaaaaggaaga

SEQ ID NO: 48114 - DNA, 656 bp, Homo sapiens
acacgcatggtttcccattattttagactggaatttcagatgcctttttaaggaatgcttaattatgattcttatcttgggaaacctttaaaaaattaaaaatgcttcgtatgtttattaaaaaaattcaaaagcgtagattattttaagtaaaacttgatattccccaaatagcactcttttctggccagtttagtgtgattccatacatacaagtaaatgtgacatgaagatgtagataccatgttgatatgtgtgtgcacgtgtgtgtatgtatataaacatgtaaaatacaggaaatacctttacatatttatgtgtaaccttttttcaaaatgtaacatgggtgttaattggaagcatttgaaacattgagtacggagaaggatttggtgacgcctgtaatcccagcattctgggaggccgactggggtggatcgcttgaggtcaggagttcaagaccagccttcatggcgactccctgtctctactataaacccaaaaattagccgggatcgtggtatcatgcgcttgtaatcccagccacttgtgaggctgaagcaggagaatcatttgaacccaggagacggagggtatagtgagccgagatgacgccactgcactccagcctgggtgacagagtgagactgtgtctc

SEQ ID NO: 48115 - DNA, 281 bp, Homo sapiens
tgttttccacttgtaaaataaggataagtagaacacctgacttataaagttgctgtgagggttaagtgggtgaacacttgtaaaatgcttagagcagtgcccagcacctcctaaaatgctattgattcctgtcttttctttttttcttttgttcctccaccagtgcctctaactgcttgtcccatgggcatcaaactagaggctgagcacagtggctcatgcctgtaatcccagcagtttgggagcccaaggcaagaagatcacttgaggccaggagtttg

SEQ ID NO: 48116 - DNA, 804 bp, Homo sapiens
cctccccacgtgctgggattataggcgtgagtcaccatgcccagtcgtttatacacatttatcaaaactcactgcatcataaattgcaagagtaaattttactgtatgtaaatatcttaattttttaaaggaaaaaaaaagtccaaaataagtagctataattaccttttccttttagaaaaaggcattcatattttctgagcatgagagaactacaggctcattgtagacatttgggaaaatgtacaaaggatgtacattcatcacgtgcagaaaaataatatttccttgctgtgagctttattggcacagaatacacacaaagctgggaccatgctatgcattttttaaatgaaattatacattttgctttctgaaatatattgtgcatatttttcatgtcattaattttcaaaatcatgattttatgaatcaataatattctatgtttacttaagagacagagtctccctttgtggcccaggctggagtgcagtggcgcaaaggaatcattgctcactgcagcctcaaactcctgggctcaagcgatcctcagtggtgggatgagatctagacccctgatattcaatctcagaaagtcaataattccctgcctcagcctcctgagtagctggggctgcaggcctgtgccactgcaccaggttcaatgtatattttattttgtcttttttttctttttttaatgtatattttttagcattcctttgttgttagaaattacattgtttatataattattatttgtcaattaaaaataaaagaaaaaatcatactgctcctatt

SEQ ID NO: 48117 - DNA, 370 bp, Homo sapiens
gctggatgacaagctttcagttgtcatgtcaaggagttggaattttattcacgtgggcaatgtgaagccatggtaggctttttagtgggcagatgatgggactgaaactgtagatagcagcagtgtacacagtggtccaaagtagggagaggctagggatcaggggcttattattttttgagacaaggtctctgtcacctaggctggagtgcagtggcgtgatcatggcttactgcagccttgacctcctggacgcaagtgatcctcccaccttagcctcctgagtagctaagaccacaggtgcacaccaccatacctagctaatcgttaaattatttgtagagatagggtcttgccatgttgcccaggc

SEQ ID NO: 48118 - DNA, 391 bp, Homo sapiens
tgacccttgtacgagtcctgtgtgttgggatggaagggcatggaggctgccccttctgctcattttttaaaaatacatgtttttataaaaattctaaaacagttgtgtacgaatgaaatctgtcaattgacccaagcagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtacatgccactgtttccagctaatatatatatatatatttgagacagggtcgcattatgttgcccaggagttcgagacctgcctgggcaatatagcgagaccccgttctccaga

SEQ ID NO: 48119 - DNA, 184 bp, Homo sapiens
cccccgcgcttggcctaggatggaaattcaaacctagatttgtgaatcttcaaagatcaccaatgctcttgagcagtgctagcctgcatctctgtgatttgccattctgaggaagtgcaatttctggtattcaataagaaccttgtgaaatgttattttgatgtaattgcaaaggcttgtctcg

SEQ ID NO: 48120 - DNA, 818 bp, Homo sapiens
tacagactccaaaaaaatctggctgtttccaaagttccccgatgacaacaacatccaagtggcgctgggaagtaattggagcaggaaagggatgtggaggggagaggagatgaagccagaggtctggctgttcctgagaagtacaaaagaacattcccagagcttcaggtacattgagatgaggtgggagagtgaggaagatttaagatgtaaaatgtgcactaccagaaaattatttaacacctccagtctctcaagagaatttaaatcttccctgttagtgtcagaatctacttgcttaatactttaaaaattagctgatggaaagaaaaattagattgaacacttcagcccacatcccatgtgtacttccatcaacacaggctcaaatccaatctggtttcaattatccggtaccttttttaatagcaaaaaaaaaagttttaatggaaattgtatttcataaggatcaaaaacagaagttttccttcctgaaataaggaaactcagataaagactgaggaaatttatggagagagatttgcagatgatactaatatggaagcaaagtggttaatggcaattgttctggaatctcagttcaaatcccagctccaccacttactagttctgtgacactgggtaagtcacttaacctctctgaacctcagttttcaacatggcaatatctatttcaatggactattaggaggtttaaataaaataatccatataaaagtgtttaccacagttcttagcatacagtaatcactccacaaatatgacctgctattattgctactgctcacaggaattgc

SEQ ID NO: 48121 - DNA, 1527 bp, Homo sapiens
atccgcccacctcagcctccctaaagcttatatattttatctctggatagtccgccctggctcagacttatacctttatataatagatatttttctagttttgaagtggatgagaaggaggcaacacatgtaatagaggtaagtacagtagcagggtctaccagtgagagctgagaagataacaatgaaaatataagcaggaaagctataactaactgataaaattgctgcagaaagcataaaaaggtctatttagtgtaggtgaaaactggtcaccacaacttaaaaatctacaagctatcattttaattaaatggtatgcaatattaatgttcatgattattatgactctgaattactgtgaggttaaattatagtaatccccccttatctgcagtttcactttccagttttagttactcttggtctgaaaatattaaattgaaaacttcagtaataaataattcataagatttaagttgtgtgccattctgggtagcgtgatgagatcctacaccttccctctctgtcctgcccaggacgtgaatcatcccttggtcctgtagatcctcacagtatatgctgcccacccatgtaatggcctaagtcatcagattaactgttgttattgactgtcaaaactattgcagtgtttgtgttattttacttaataatgacctcaaagtgcaggagtagtgatgccggcacgttgttataaatgttccattattagttattgttgttaatctcttattgtgcctaatttatacattattgatcataggtgtgtatgtaaggcacacctcattttgttgcacttttattgcacttttcagataacttttttttttacaaactgacagtttatggcaactctgttgagcaagtctgttggtgccatttttttttaacagcatgtgctcacttcttgcctctatatcacactttggtagttcttgcaatatttcaagctttgtaaattattgttatatctgttatggtgatctgtgatcagtgatctttgatgttactattgtaattattttagggcaccacaaactgcgcccatataagacaacagacttaattgataagtgttacgtgtgttctgactgctccaccaactggctgttttccagtctctctccctctgttcggcccccccatctcctaagacacaaaaatattcaagttacaccaataataaccctccagtggcctctgagtgttcaagagtaaggaggagtcgcatgtctcactttaaatcaaaagctagaaatgattgagcttagtgaggaaggcatgtcaaaatgcaagactggctgaaggctaggtctcttgtgctaaacacttagtcacattgtgaatgcaaaggtaaagttcttgaaggaaattgaaagtgctgggctgtgcgtggtggctcttacctgtaactgcaacactttgggaggctaagatgggaggatcacctgaggccatgagtttgagaccagtcctggtaacatagcaagacctccatctctacaa

SEQ ID NO: 48122 - DNA, 342 bp, Homo sapiens
gggaagatcgcttgagtccaggaggcaaacattgcttctcctccaaatgctgtactttaacatgtttggaaactcctgcaaaggaatttcaacataagcgaagtcaatgggttataaaggactgaatgccattttgtaaatgtcagaaatcaaagtcacaaccaagttaagttctagattagggccaggaagagaaatgtattatctggtcaaccatatcaaatctgtattttggtggaagagcattttcttatattggttctgattggtttgatacggacagggaactgttttctttattccagttatttgttttgttttgtttctgagacagagtctcgc

SEQ ID NO: 48123 - DNA, 421 bp, Homo sapiens
gatcacctgaggtcaggagtttgagaccagcctggccaacatggtgaaaccccttccctactaaaaatccaaaaattagctgggcgtgggggtgggcacctgtagttccagctacttgggaggctgaggcaggagaatctcttgaacccaggaggcagaggttgcagtgagccgagattgcaccattgcactccagcctgggtgacaagagcgaaactgcatgtctctctctctctctacctatctatctatctatatacctatatcattgtttattcattgttttggctatctttatgatggggaggagcactagcgggttccagtcttgttctcctcccgagtgtgatagcatttttaatggacaatcctttagggcatctttccaaagctttcaacttagtttttgtttctgtactta

SEQ ID NO: 48124 - DNA, 550 bp, Homo sapiens
ctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgttccctgttctgtttatgcggaaatggcagaaatgcttgagaaatgagaatgtgtaagtggattggaagtttatagtatgaaatttcaattttactttgtactgtacatctttttactttagaatttgcaataaagggttacgtcaatcttgttttcaactctcacttgga

SEQ ID NO: 48125 - DNA, 639 bp, Homo sapiens
ggcttcaataccctgtattattgtttaggcatgtgagagctgttcattgtgtggcttgatggaaataaaagtctctaccatcacttatgttgaatgtttgttttccttatatcactcaggcccctctaccacaaaggtggattctatcaactcattaagtggtttttgataatattttctaggtcattgttaatatgttgtaaatcagtagaaaaggagacatataaatttaatcaagattttgtaattattccaaggaatatgaccttatattcttttctttgtagagacacttttgctacattgcccaggctgatctccgaactcatgggctcaaatgatctacctgcctcagcctccctaagtgctgagattgcaagcatgagtccctacaccctgctgatcttatattcatattgttgtaaaacaaccttttgtgaatcagttataaaaagcaacataattaaatggttaattatgtacttataataaatagcaaatatgtacttatggcttggaataaaatttctggtaagcagcacatacaaaattaaaaataattatctctcaatttggacagaacagaagataatatactctggaaatatgtgtaagaaggctcaaaaaaatgggaccggt

SEQ ID NO: 48126 - DNA, 663 bp, Homo sapiens
tgctgttccgcaaaggctctgaaacattcccttacctggaatactttaccaccagacatacacatggcagaccccttatgctttctccccatcaaattgacagtaaatacctaaaaaagggtataaacacaaggacaaagggatcagaaaaagcaacaatagtgaacaagagataatcatgaacatctggaatgcagaggcagatagggtgtaagctccagaagatgggaattttgttcacctcattcaaagtatcctgcatttggcatatagtagtcatcatttttgtggataaatgaatagctatacccatgtgaataaactatatcttagcaattcatcccttacaaatgaattcaaagttacagaagttcttctggatggaatatatgaaaaggcagaattaaaacaatcatgttttgtttactaagctgtcaaagagacacttttgctacattgcccaggctgatctccgaactcatgggctcaaatgatctacctgcctcagcctccctaagtgctgagattgcaagcatgagtccctacaccctgctgatcttatattcatattgttgtaaaacaaccttttgtgaatcagttataaaaagcaacataattaaatggttaattatgtacttataataaatagcaaatatgtactta

SEQ ID NO: 48127 - DNA, 734 bp, Homo sapiens
tgctgttccgcaaaggctctgaaacattcccttacctggaatactttaccaccagacatacacatggcagaccccttatgctttctccccatcaaattgacagtaaatacctaaaaaagggtataaacacaaggacaaagggatcagaaaaagcaacaatagtgaacaagagataatcatgaacatctggaatgcagaggcagatagaaaaattattagggaagacactaaatgagtctttcgactttgaagaaaagcaagtggacttgaattccatgggtgtaagctccagaagatgggaattttgttcacctcattcaaagtatcctgcatttggcatatagtagtcatcatttttgtggataaatgaatagctatacccatgtgaataaactatatcttagcaattcatcccttacaaatgaattcaaagttacagaagttcttctggatggaatatatgaaaaggcagaattaaaacaatcatgttttgtttactaagctgtcaaagagacacttttgctacattgcccaggctgatctccgaactcatgggctcaaatgatctacctgcctcagcctccctaagtgctgagattgcaagcatgagtccctacaccctgctgatcttatattcatattgttgtaaaacaaccttttgtgaatcagttataaaaagcaacataattaaatggttaattatgtacttataataaatagcaaatatgtactta

SEQ ID NO: 48128 - DNA, 335 bp, Homo sapiens
tttctgacgtcacttcctacttaacttggctctagccacattcgctcccctgctgttccgcaaaggctctgaaacattcccttacctggaatactttaccaccagacatacacatggcagaccccttatgctttctcgtgagtagtcttctctcctaaactacattgttagtcatgtattgtattaagatgtttgggtataactatacattctgtaaataccaagtccctgtatctgtcttagtgcctagaacagatccaaggacacagtagataagacttaaggactacctgataaattaatgaataaatctgctgccatttcatccaaataca

SEQ ID NO: 48129 - DNA, 736 bp, Homo sapiens
gaaaacaggactagaccaatgctgaccaaaagaagggttccacatacatgatgtgtagtgtggtcattctgagtgtctcatccatcctgaccaggtggggacctgccagacagaattccgagaggaatccctggctgcatccaacagcgaagcgtggctgtgcttcctgattgggcatcgtgtgctctgcgcccactccctacctgcttagaaggccccttggtgctgggtttgaatgtgggccatggacccccaggaaggccctggggccttctaaccgcccatggacacctacgcagaagaacaaagtggagaaattaaggactggggcagctgtcataattcatgtgttctgttctctctccagacatccaagaaaaagccagtgactgttcctgagggcgcctgttaagagctggctttttggctgtggtgaccagtcagtcacgaccactcttccgagagcaacaccaagtggaaaccccgccaagtgggcttttcaggaaccctctcaccacccaaggcctttggatcttatatctaacaaattacatgttacattattttttaaaaaacaggttagtgacaactaagatagtctctccagaattagagtctgatgtcagattcagaaaatcccccgttccttgggaattcccatgtcactcattctgcattaatgatatttattctctctcattgttttattcttaaaaaatagctcccctggttgcaa

SEQ ID NO: 48130 - DNA, 297 bp, Homo sapiens
atatacatttagtcatagaaatgtgtgtccttacttacattaaacaaccttacgactctgtcccatgcagtctatgctgcaatgggatgtgcatgtcttgctttggtatatttactacaaaatcttagtctctgtttccatatatttcaaagttttgtccaggcattttcaactagggatgtgagaggtcaaggagaatgggcatgatttttaggaaagagcatccaaatttctaggatgaagaaagggacttttaaaagtatattaaatatgattatattgtgtttaaaaaataaa

SEQ ID NO: 48131 - DNA, 823 bp, Homo sapiens
  misc_feature (633)..(633): n is a, c, g, or t
  misc_feature (686)..(686): n is a, c, g, or t
  misc_feature (699)..(699): n is a, c, g, or t
agcggggtttccgggatttggcggcgcctttgtctctcgctgcagccggagctccaggtctcgctttcactgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaaggtgcacaagggaggttataatggacttaaccaatgtttaccaactatgcagagcaaaatgtttcaatgtgataaatatgtgaaagtctnttaataaattttcacattccagatagacataagataaaaatatggaaaataanctttcaatgtaanaaaaaaaaaaaaaactggggatctatgtggggggggggaaaggggtttggaggggcatggtcatggggttcggcccggttttggtcagggggaacgggggcccaaggggggaaaatgagccgta

SEQ ID NO: 48132 - DNA, 969 bp, Homo sapiens
agcggggtttccgggatttggcggcgcctttgtctctcgctgcagccggagctccaggtctcgctttcactgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagagtctcgccctgtcgtccagcctgaagttcagtggtacaatctctgcttactgcaacctccacctcccaggttcaagtgattctcctgtctcaccctcctgagtagctgggactataggcacatgccaccatgcctggctaattttgtacttttagtagagatggggtttcaccatgttggccaagctggtcttgaactcctgacctcgtgatccatcttccttggctcccaaagttctggtacaggtgtgagccacagagcctggcccaaaatgtcttgttttgggtgttctttcactttcgagatggagtttgcgcctggttccaggctggagtgcctggtgcatcctgatctctccaactctggctactgggttaaggatttctatttcacctcctggtttttgggtcccgggtggccccccccgggggattttgcgcgttgaaaacgggtgcccggtgcgcgtggtgtaccgcatgtggttgcgcgccccttgtgggagcagggcggctctgcgcccatgggacggcgcgagaaagttcatgtggaagagttgcgtcgtgcaac

SEQ ID NO: 48133 - DNA, 243 bp, Homo sapiens
ggactgttgacatttagggatgtggccatagaattctctctggaagaatggcaatgcctggacactgcacagcggaatttatataaaaatgtgattttagagaactacagaaacctggtcttcctgggtaaggataacttaaacacacagtttctttttttttttgtttttcttttgagacggagtctggctctgtcaccaggctagagtgcagtggtgcgatcttggctcactgcaacctcc

SEQ ID NO: 48134 - DNA, 482 bp, Homo sapiens
agcggggtttccgggatttggcggcgcctttgtctctcgctgcagccggagctccaggtctcgctttcactgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagatctgtgggacagacccagcaggtggtgccccatgtaagaagcaatgaaatgcatcatgatggaaccctcaaaaacgaaag

SEQ ID NO: 48135 - DNA, 309 bp, Homo sapiens
ccctcaccacacctgtagttgcatcccaaggaagtgcccttcctagaattcttacccttggaccaagggccactgtttgagatgtggatatgctgtctccctctgtgaccctgggaaggtccctcctcattctagacctcagtttcctcatctttaaaccaaggagcacaaatgatatgagagtcaggctttccagacttaatattcattgcttctgattggcctttcaggttaaagctccgtatgtggcctgggaatggtagttggctttctgccttggtcctcaacccaaagagatgctggcgtctg

SEQ ID NO: 48136 - DNA, 105 bp, Homo sapiens
cgcaatggactctgcttgaattccctgcctcaaggatggaattctgggctttcctcaaggccagctgctgcatcaccacctcctcccaaaactgccctgatcaag

SEQ ID NO: 48137 - DNA, 604 bp, Homo sapiens
ggaagagtctcttggcattcttgaatcaagcatatttcttaacctcactgaggctcagtttcctcttatataatatggggtaaagagccctcaccctgcctgccacacactggtagtgtcagataacattgaagggtgttagtttaaaggcttcatggactctataatgtcaacaaaagtgctgttaactttcttctgggtctcaggctcctgatgtagagtcagtggagcaaccctgccatctgctgttatgctgttgatgttgctgccacacttactaacctaaacctttgattctggctgtggccttctccagaaggtgtttactcatttgtccattttatcttttaggaaacagccagcccgtagatcattaaggctggctattggacagggggctggggcctgcctgacagaggaaggaagggcagacatctggttcttcctctacccctacaagagactccagcctgacacagagtggtactcctaggatgtagcagcagcatatgagcttgaatgtgccttaatcctgctctttactttgagaagagagaactaaggacccacagatgtttcacagcttctataggaggcagaggta

SEQ ID NO: 48138 - DNA, 252 bp, Homo sapiens
ccatggggccaagagctctggaagcctggccggaaagaccaaggttcatgcagcccaacaaatgattgttgagcacctctcggagccaaagtccttaggcgagtgtggtgacttcctggaaggaggatgcagacttccagagagcccccccaacggacgtgctgagaagggagagggaggcgggggctgtagtcaggaaggagccagagaagaacagggtttgggtgcatccagaaatatgcctgcagtagg

SEQ ID NO: 48139 - DNA, 490 bp, Homo sapiens
tgccattcacctgcctgtgtttggactgttctcactttgtgtattaaagcttccttaagctacatgtttctgagcctcagtctcccaatctttattgcatttttcctaatgcttgtcagtcaacttaatctgaattctaatttctatatattgtgttccaatctctagctctccttttctaaaaaatgggcactttccaatgtaatgtttagtgtattaaaaaatattaacttggccaggtgcggtggctcacacctgtaattgcagcactttgggaggccaaggtgggcggatgacttgaggtcaggagttccagaacagcctggccaacatggtgaaaccctgtctctactaaaaatacagaaattagctgggcatggtggtgggcacctgtaatcccagctactcaggaggctgagtcaggagaatcacttgaaccaggaggcggaggttgcagtgagcctcggcaagagagcaagactttgtctca

SEQ ID NO: 48140 - DNA, 438 bp, Homo sapiens
ctctgttgcccaggctgctcttgaactcctggactcaagtgacccttcctcctcggcttcccaaagtgctgagatgaaaggcgtgagccaccgcacctggcctggagctgcctttaaagctgacccagaacctccaccatgcctgtccccacactggtctgagtccctggcctcatgcactggaatccacacaccagcctgtctggtctctctgcttccacccttcttcccatagcagcacgtgcggtcctgttagacacgaaaccagacatgggtcccctctgcccagaccctccgccggcatgaatatcttgctcagagtgaatacctgagtccttgtgtggtctctgcattcctgtgtgatctgtcccctcctctagcacctcccgccccctttttttcctcctctgccctttgctcactcagctgcagccacac

SEQ ID NO: 48141 - DNA, 356 bp, Homo sapiens
aacacctaggcagtgttttacaaagtatatgcatcaaccatgcatcagaatcacctgagatacactacaaactactacacagccataaaaaaaaatgaaatcacgtccttttcagcaacgtagacatagctggaggccattatcctaagtgaattaatgcagggacaaaaccaaataccacatgtacatctcacttagagctaaacactgggtacacgtgaacatacttatgggaacaaacactggtgactactagaggggagacaggaggaggggaacaagggctgaaaatctatctactgagtactatgcttgccacctgggtgacaggctcactcgtaccccaaacctcagag

SEQ ID NO: 48142 - DNA, 279 bp, Homo sapiens
aaaattaaaaaataaaaaatgctttaaattaaaaaaagaaagaaaattagggtgtttctgaccagatgacagggcagcagatgcaaaaatcattgtggtgtggcagcaggagcatcacaatttggaccagatcatctgcgtgtccttgaacaaggtgctgtcacttctctgagccttggtttccccatgagtcaaaggaagcaagtaaactccagctgatgagactgtgtatggcaagaatgtcgcatgtgctcagggcagggtcagtgctcaataaaa

SEQ ID NO: 48143 - DNA, 126 bp, Homo sapiens
tgattgtcctgaagaatcagagaggagtactcagggtgttgcaagtcctgattaggcagaggcattaatcacatttcatgcatctccaatcatcatgttctatctgccctccaaaacgaggaacag

SEQ ID NO: 48144 - DNA, 884 bp, Homo sapiens
ttaaaaaaatcttcaatcacctgacacctgctaagggaaacagaggcattcctttgttccttgaaagtaatcatccctttcttcttacttcctgctatggtttgaatatttgtccctttccaaaacacatggtgaaacttaattcccaatgtggcagtactgagaggtgaagcctttaagaggtgattggatcaggagggctctgctctcatgaatggattaatccattaatggattaatgggttatcatgggattggaactggtggctttataagaagaggaagagagacctgagctaacacattcagctccctctggcatgtgatgctctgtgctgcctagggactctggcagagagtccccactgggcaagaagggtcctcactagatgcagccccttgaacctgggacttcttatactccataactgtaaggaaataaattccttttcataataaattacccagtttcaggtattcagttataaccaagagaaaacagactaagacacttccagatacttttcttctaggttttcttcaaggctttcaaaatctttaccagatttacttctcaaacaccctcccctatgcctgagttttctgtatcttccaggttgtgctctggtattataggacaatgattacttcgggtaattcaatcatagtccacttactcaacaatctcattgatttcccatagcttgacaagattcacgtgtataactctcaccacccttcctatgggtctatacttctatttccaattgcccactggatgtcataacctgaatgtcccctatgaaactcaaatcaacatataatcacaacctgaatccatggtccttcttacccttggtcttttatttttttatttttttcac

SEQ ID NO: 48145 - DNA, 402 bp, Homo sapiens
ttaacttacacatacacacatgcgtgcacacaacaacacttaatgcttttggacccaaaatatcttcaaactaccatattattactctccttgatttcactgccaaatttatgttaggaagcatctgtaaggggttcacagtgaccagtcctgtaatcccagcacttaaggccgtggcaagtggatcagttgagcccgggagtttgagatgagccttggcaacatggcgaaaccctgtctctacaaaaagtagaaaaattggctaggtgcggtagtgcatgcctgtagtcccagctactctggaggcagaggtgggaggatcacataagcccagagaggtcaaggctgcagtgagctgtgattgcaccactgcacaccagcctgggtgacagaatgagacac

SEQ ID NO: 48146 - DNA, 257 bp, Homo sapiens
caaaagacttgagagaataggccaagtgaagaccaaactgagttggtctagttggggctggagctaagtaactaaaccacagagattggttttgcttgctgggggtatagaggggattttcaggaaagtaagaggtaggctgggcatggtggctcatgcctgtaatcccagcactttaggaggccaaggcaggtagattgcttgtgcccagcagttcaagaccagcctggggcaactggcaaaaccttgtctctaca

SEQ ID NO: 48147 - DNA, 335 bp, Homo sapiens
aatagttatactctttcatcaaacatgtgttcagagccagtgaagtgctggtcagcctaacagaattggaggcaggaaagtatgatttagctgtgtgcccagaaagaaaatgaaacagatttggctgaatacttattaatctctgcctcaacaactaggattatattcccatttcataggaaatggaggcactgagagaatgagtaacaagcctaaggccacataggtagaaaaaatgatataatcataatgtagttgtgtttcaaactcagtcctgttcagttcaataaacatttgtccagtcctcattctatgatatgtcctgtgaattggca

SEQ ID NO: 48148 - DNA, 426 bp, Homo sapiens
ctctgagcctttgaacacttgccgtttctattcctcacagcagccctttcagacggaacgggtgttaccagattaggaggagagtggccactgtattctcagtgcccagcccagggaggcagatctgagtggagttgctaatgaaacatggaaggtgcttgagagctaactggaagggagggaaggtgtgcattcctgcaccagggcctttgcatgtacttgttactttctcctgctggccagctggagtgtctggaaagatctgccttactcagggaagccttctcactcgcactctgcccagttaggaccactgccctctagagaccctatagaattacagaggaggccgggcgtgatagctcacacctggaatcccagcactccagcctgggcgacagagtgagactccatctcaaaaaaaaa

SEQ ID NO: 48149 - DNA, 461 bp, Homo sapiens
ctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctacaagggagttaaaagctggttgaagtgagtgttttgggggttttctgtgaattaataattttgaagaggaaacagccctggtgcgtggggcacattttcgtagagaacacaaagaaaagaaaacctctttggtacatattttctttcagtatttttgggcaaggagaatgatgtactttttactgacaagagtataactaaagttgccattaacagaaataaagcccagttatcataaaggaactgaagtccaagatta

SEQ ID NO: 48150 - DNA, 470 bp, Homo sapiens
gtacaatgccttagttaaattgacacataaaattaaccaattaagtgattaatttcagtgggaagattcagcattctcgtaaatgaaattagctataaaaaattgaaattattataaggaatagtcacaagttataaaagaaacattcattgctatggccaggaatatattgctatattggaatctttaagggcagaatggaaaaaaaatgaaagcatatgaacaattattacataacatataaattaggaaattttaaaggagaaatgatcagaatttaggaaagtattcttaaaggatgtgaattttgataaaaatttgaagaaagtatgcatgctgtgcatatatggagttggcagagaagcctgataagtagagtaccacaggccttatgagaggcttggggaaggaaggacagggagaaactggcaaagagcgttgcatatacattttaaatttgtttagctgga

SEQ ID NO: 48151 - DNA, 564 bp, Homo sapiens
ggagtgaaaatcgatgtcatatgtaaactagaataacatgtcagtaacttttaaaaacatagctaacactcacttattcattcaagggagggcttctggctcatcagctattttaggtttctttacatttgctttgaaaagctttctgtggctctttatagctgttttacccaatcagttcctttttacttaggataatctcaagatgggctgcagtctgtgcagacacacaggctgagcagtgaaggggtgtgagctggggatgtgctgagctgcctagcagatccctgggacttagggtaagccttagagagcctcagttatttcgttgcacactggaaattgagagctgactgtatattgtatgccagcattttaagtatcgtaatctctcaatcattcatgctaatgaagggtagctagagataacaaagaaaagtgtaatcaccaaatcatttctttgcatcttcagccagagctgtgatctctttgggttccgccttgagtcctcatgtccattagcccagtctccagaataatacatagtaggtgttaaaaaaaaaa

SEQ ID NO: 48152 - DNA, 644 bp, Homo sapiens
tgagacagaaaaaaggagactgagaagacaaggctggaattccatagctcctatagatccagggtcgctcaccctctggtgtgcctcagagcagtcactctagtggacgtgcagggagaggaataccacatggtgtggcagcaaagcaaggagcccggcaccaccaggccgctccgtggtgctggtagcaggtgctgcatgtttataccaaggtactgtgaagcttccctggaaggggtctttctcgacatctggtggccaagctgaaagtggattaccatttggacatctcataactaaaagatgatgagccagcggggcctctgcacagctttctgcacgatgaccctgcaaaggtacagctgtgccctgcccctggccttctgcagctggcccatctgcagcttctgctgagtggccacatgggtggatgctaagtcttcaacagctaagttcaaagtgaaccctgcatgcccccactgtgtgttgatctcccctgatccaaaataatgagagaatgaggggggtgcagaaactatccaaaacattaatagacatttaaggagccctgtgccgctctctttttcatccccttcttggtaattgtcccatgaatttagaggcccctgaagggaattgccttt

SEQ ID NO: 48153 - DNA, 403 bp, Homo sapiens
aatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaaattttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatattttttttt

SEQ ID NO: 48154 - DNA, 347 bp, Homo sapiens
gccctgcaatgtattctctcttgctttctacccacgggacagaacttatttgggactcatgcatgtgcagcctggaaacatgtggagctgacacctgtgggctgcctttacaaatggatgccaacagagaaatgcttcccccttttactcaaggtacagatggtgttgagatgcatttcataagcttcttctgaagtccttgctggatggagcatccctgcctttggtgctagtcaacctgaaaatgcatctttgtattcagcctccctccttccctgttctcctcctgtcctttattgctgctccctggaatcttgtccccaaagcataaactgcttaactgcaca

SEQ ID NO: 48155 - DNA, 390 bp, Homo sapiens
tcaggtgtgaagccagaaagacctgctgaagcacgtggctgcaagcctgagagagcgaagcccagggaccctgagtcagttcacacacgagggctcgtgcgcaaggtccttgtcaaatgccacctacacctggggccaccctcattgaaatgtcactcccagcccctcaattcccacttgctagttgcctactctactgtatattctagtttcttgtttattgtctgtttccccctaatgtaagctccctgagggcaggaaagatgtctgctctgttgtctgccccagtgccagccctcagtgctaagcgaataagggcaagtcagtcagtgggaaactgctggcaccgggcaggccctgcctgagtgccatctgtcctttttattgttg

SEQ ID NO: 48156 - DNA, 352 bp, Homo sapiens
aaaaaatttaaaacacagagaaaccaaaaaaattaaaagaatttaaaaatacgaaaaggtatacagcaaaaaagtctccttcccctcttcctttagtcttctagctttctcttctggaagaaaccactgttaccaatttcttatgtattctcctatgtaatcactcttaaacatctgaacatttgggatgaatctggcaaaagagaaaataacttatatttgcttagctattttctgaggatgctagatgactactcttataatatgtctaaatatattattatttttattttgttgaggcagagtctcaatcatcactccaccctgggtgatagagtgacaccctgtctca

SEQ ID NO: 48157 - DNA, 674 bp, Homo sapiens
ccccctcgagggcccaataattcgggccaccgaggtagggagtcagatgtttgatggatattgactcctacaaagcaatactaaacagtacaactttcagaatgaccatttaacacctagacagtatttctattcctgctttccagaatgtaattttttttaagcatccatagggtgggtcacattgataatcactgtaactaatactttgtcagcaatcctagtgcctaaatgtgtataactgcattttttaacctaaatgtaagacttgatacttcaactttttggtttaggcccagcagtttgggtattccacgtggttaatcattttaaagcttgtttcaatatagtcttccaaccagactttccaatttgtgtcacttacagatttggcactaccaccatctggtctgtatgtaatcctttacagtttgcaaggcacttttacatccattatatttaatttgattcttacaaccaacttgtgagataggcaagatgtgaagtcgatattttatagacaaagcagctgaagcataataggagcttaactggtgggatccatttatccattttctcttccatggagcatcttgttgtattcatccaaatccttgacagaaatgttgaagaggacctctagaggctaagcttatcctgaattcttaaatagc

SEQ ID NO: 48158 - DNA, 352 bp, Homo sapiens
aaactttccaaatcttacaactgaagatttttaagcaatttctgttttgcacttaaattggctctgggcagggtaaaacacacacatacacacacacacacacactttggttaaacacgtggaaataagctatgggtgtagcagactatcaaggccttgtcactttaaacattcaaacgatagattttcctttgttctaattgcattgtcaccaggcaaccttttgattattttcattcctattagatttggctacagagagcaaccatttctggccacagagatgtgggtttctgatcggtttgacaattacatgtacattttttgtatattactaaattgatcaatttta

SEQ ID NO: 48159 - DNA, 432 bp, Homo sapiens
ctatctccagtgataatgtgctggtgatgactaattaggtgcaccatcgttcggagactcagtaaagactacaaatgaaaaaacatagtcgatcaaggcatgattcacactcaaaggactcttgaaacaagcaaagaactttgttgtttagtctggcaaacatttcactttgaaaataatcataaatgaaaaccatgctccctgaatcttccagctatctatgtgaaatgctcttaatttcataggtggttggtaagggaccaattactttcgacatgtgaatgaaatgacatcatctttgccaaacaatgtgcagtgaaatgagagaccaccttccttatggcatgtttcatatgttctctctctctctctctctctctacaaattggcccatgagtattccttcactttctcattataacaaaaaaaaaa

SEQ ID NO: 48160 - DNA, 875 bp, Homo sapiens
acatttactgtactacagggaatctctcatttcaaaatgacctgtgttgcagttattgtttataaaactgttcatttatctgacgtaaggggctaatcaaactgcttaagtacattcctggatgtttggaagatttttaagcgccatagagagggtacttatgctatggaaattgtgtttatatatatatgcataattgccactgaaattctgaacagacccaaaggaagaaaaatactgtgatttaaataaagctaacataattaatttatatctattttatatttgacttagtgggataaattgttttgtggaaaaccatattataaaatagtctaagttttttatagttgaggaagaatttgaggtgaaagatcatgttaattgtaacaattgcccagtactttgtgttcactatgtgtctggcactgatttatgtttattaatttactacatcctcagaacaattcagtgaagtaggtattactaatattcttactttgagattatgaaaccgaggctcaggtagtttaaataaatttgccatgtcacacgcagtggctcatgcctgttataaccaacactttgggatgctgaggcaggaggattgcttgaggccaggagttggagcccactctggggaaaacatgttgagatcttgcctctgcaaaaataaagtaaaataaaatttaaaaaaagtaaaaaaataaaatcagctgagcatggtgacatgcacctgtggtaccagctactttggaggctaagttgagaggcagtgatgggaggatcatttgacggcccagaggttgaggctgcagtgagctgtgtttgtgtcattgcactccagcctgggtaacagagtaaaaccttctgtc

SEQ ID NO: 48161 - DNA, 326 bp, Homo sapiens
aaaccaataaaattgaagacagtaaaactaaagaaaatcaatgaaattaaaagatggtcctttgaaaaagagagaagacataaatcagcagcctcacggatgaaaacggggtgtcactataggctctacgagcattaaaggatagtgagtagtgagtattatgaacaactctaaataaatacattgtaaaatcaatttgacaacttagaagaaatcatggaccaattccttgagaaacacggcctctcactgtattagctttctattgctgctatgctaacaaattaccatgagctttatgccttaaaacattcccagtcaatttt

SEQ ID NO: 48162 - DNA, 713 bp, Homo sapiens
gctagatggttagtgcggctctctggaggacttcctttcgagtcagggactgacgcggcgtattttcgtggctacgactggatattctgcgcagaagagggtccttgagagcgctggccgtgccgtgccgccaaacactcctcaccaccgaatgtgggaaacgtcttccttggagtctagcactccctgcccgccccggatggaatttggttttctgcgcagggtcgccccttggagcccgtttccaaatgattttaagagggaagggaatctagggaggccgattccaggggcgagggtggaaaacccaggccgggcagccgaggagcggcgtgggcactagaagcggctcgccgcttcctactgtgagaggcggaaagcgaagccccggggtgtgccggggcactcggaatgtagacaagtttggtgcccagcgaaaggaagaggtgtggactgaaagtacgaacttgggaagtcatcaacagtagctggtggctggcatcagtggagtgagttgagtctttcagagccatggtctccaaactcgagaatgcaaacctctgagagtgttgcggccaggaacgttttcaggacaccagtgtttatcctatatcctaaaatgttgcctaacgataatacactcttctcccgctttacacaagaacggcgcacccctcgccaatcctcagtctaatcttactgtgatgtgtcca

SEQ ID NO: 48163 - DNA, 446 bp, Homo sapiens
ttccaataaagagagatagggaaaaaaaaaaaaaaaaaaaaaaacactgctttttagagactacattatgtgcctgaaatagcaatattaatggtccggattggcgacttcatttcaacttatgtttaaggggttcttgataatctgacatgataagtggtgttggaattggcattaaaatccaccatgttctacaacacttcatccttcttcggcaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48164 - DNA, 1412 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcaggccatttccaatccagcggaagaccttctagaagagatgatggtgggagagtgctgacatactatgtgaagctactatttggagttggacacgagtgcatgtgtccttgtgccacaacgggaatgtgagctggatgacaaatggagatttggacttgtgataattggcctctgtgtcattgtgtggaagactgactggtccctttatttcctgtagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48165 - DNA, 1522 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcaggccatttccaatccagcggaagaccttctagaagagatgatggtgggagagtgctgacatactatgtgaagctactatttggagttggacacgagtgcatgtgtccttgtgccacaacgggaatgtgagctggatgacaaatggagatttggacttgtgataattggcctctgtgtcattgtgtggaagactgactggtccctttatttcctgtagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccagttcatttcaacttatgtttaaggggttcttgataatctgacatgataagtggtgttggaattggcattaaaatccaccatgttctacaacacttcatccttcttcggcaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48166 - DNA, 1320 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcaggccatttccaatccagcggaagaccttctagaagagatgatggtgggagagtgctgacatactatgtgaagctactatttggagttggacacgagtgcatgtgtccttgtgccacaacgggaatcttgactacaacacaaatgaatccactcaaatgttggcaagtggagcagagtcccagaacagtctgcaatctctacaggtacagaaacacccccagttcaaggatcttcacacctggatttaggcctactcctgcaactaccccaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48167 - DNA, 1285 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcaggccatttccaatccagcggaagaccttctagaagagatgatggtgggagagtgctgacatactatgtgaagctactatttggagttggacacgagtgcatgtgtccttgtgccacaacgggaatgtgagctggatgacaaatggagatttggacttgtgataattggcctctgtgtcattgtgtggaagactgactggtccctttatttcctgtagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48168 - DNA, 1276 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccaggccagttatccaggcagtgactttcagtgcagctacagtcacctctggaaacctgtggagactttaaaaatttccaaaaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48169 - DNA, 1396 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccagatggagccatcccagccatgacaacagagaatgtaccactctcacatgaggaagaggggtaggcagtgctcctgtatcaccagcccttaatgagaccctgaggaaaccacatcatggagatcagcccttctctcctggggtaatattgagttccagaaggcaaggattaacattcagaaaataggaaaaacaacctgcaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48170 - DNA, 816 bp, Homo sapiens
agtttcccagctgaattcaaactcattcccagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaggtaccagataagcaaagcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggaaatcccacttccaactggatgtctggatgaactactgaaagctgctgagtgtcctgcagcagcctttcatcccaaagatgcagccgacttgattgtggtggataagctttttgatgtgctgctggattccgtttgctagtattttattaagaatttttgcattaatgttcatcagggatattg

SEQ ID NO: 48171 - DNA, 572 bp, Homo sapiens
tctgggttcctgctttccttccaggaaatcccacttccaactggatgtctggatgaactactgaaagctgctgagtgtcctgcagcagcttgactacaacacaaatgaatccactcaaatgttggcaagtggagcagagtcccagaacagtctgcaatctctacaggtacagaaacacccccagttcaaggatcttcacacctggatttaggcctactcctgcaactaccccagttcatttcaacttatgtttaaggggttcttgataatctgacatgataagtggtgttggaattggcattaaaatccaccatgttctacaacacttcatccttcttcggcaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaatttagtatgaacgtttttatgtgggagctcttgaaatggttgctgctcat

SEQ ID NO: 48172 - DNA, 914 bp, Homo sapiens
  misc_feature (841)..(841): n is a, c, g, or t
  misc_feature (848)..(848): n is a, c, g, or t
cgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcaggagagaacccctggagttcctgcgggaccagccccagttccagaacatgcggcaggtgattcagcagaacctgggctgttgccgctgtcngagtggncagggaactcagtttaagaaacaggggcagagcgttctcaatgtgaacccggggctggggcccgtg

SEQ ID NO: 48173 - DNA, 494 bp, Homo sapiens
  misc_feature (451)..(451): n is a, c, g, or t
cgctaagatggcggcggcgtgagttgcatgttgtgtgaggatcccggggccgccgcgtcgctcgggccccgccatggccgtcaccatcacgctcaaaacgctgcagcagcaggtgattcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcccgccctgctccagcagcctgggcccaggagaaccctcagcttttacagcaaatcagccggcancaggagcagttcatccagatgctgaacgagccccctgggaagc

SEQ ID NO: 48174 - DNA, 711 bp, Homo sapiens
  misc_feature (638)..(638): n is a, c, g, or t
  misc_feature (645)..(645): n is a, c, g, or t
cggtacccctatactgactacgcggctgggactctgctgcgggggagctgaggccccacctgcagacctgctgctcacctgggcaggtgcctcctcacagcccatctgcacagctggcctgcggagtcctcctcaggggccactggccctcatctgccactgtcgaagggatgcctgcccctgctctccccacctcaggcatgtcccatcccccacctgccgccagagaggacaagagcccatcagaggaatccgccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcaggagagaacccctggagttcctgcgggaccagccccagttccagaacatgcggcaggtgattcagcagaacctgggctgttgccgctgtcngagtggncagggaactcagtttaagaaacaggggcagagcgttctcaatgtgaacccggggctggggcccgtg

SEQ ID NO: 48175 - DNA, 753 bp, Homo sapiens
acgcgtccggtgttcttcccaccgtgtgtcaccctgaccacccgcctgtcagggccagcgagccgaggccaggatcctgagctgtacccagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgat

SEQ ID NO: 48176 - DNA, 1132 bp, Homo sapiens
cgccccggcgaatggtcccccgagggcagccatccgcagacgcagttccctgattgccccagcaaaaatgggcggtctccttgggatagattctgcgcgggctgctcttaagaatttaccggcaggcaggtctggtcccagcagaggagacccaggggtcccagagctgggctggcgggaggcgtaatccggcggggtgagggttgatcgaagagccccgcgcgcagctgccgctcacagccccttcccgagtgcagagcgggcagagaaggtaagaagcccacccacccactccccgcctcctgaagcccgtgcttcagacctgtccctgcaactggggaagagccaggcgggctctccgcctcctcgatcctcctccctggaagaggcccgaaggcagcggccgccagacacacgttcgcctagtccgtcacccgacggctctgcccctcaacaggggctcctccaccgccacgtacacatccgcggctcatgcacgccctgaatgatcggctcagccggaccccctggttttttgttcacttactggaaccttcttttgcagaaaatcttgtttgctgtgggatccacagatgggtccgcctccctcttttagtgtaaaaaagcagtgaacggctattatggtacatttttaaaaaaatcaaacagaagccaaaaccactttaatgtctatagaaggacacgtctaatacatttaaaataagcttcagctgttctgaatacagttcatggtatttttatttaaagacaaattctttagaatgagcctgtaaggtgggtaggtcagaaaccccattttacagtttaacaagtggacatttaaacggctagttaaatgatgagtctaagatcacggtttcagaaactaagacttgggcaaagctgctctcactccgaatctaattcatgttccatgaccctacactgcctctcatgatgtagagaaatgaggagtaaccttaccaaatgtacttcttaataaactgcccctaccacacagcagggtccgtcaggccagcgctgacacaggtttgcaggctcccagtaaatatgaagtgaaggacaagtcaggaagtgggaagactggaaaggattgctcatcggaaatcag

SEQ ID NO: 48177 - DNA, 401 bp, Homo sapiens
atgagagctcgctgtactatctttgcaacttttccgtcaatcaaaaatgattctgcaattaaaagtttattaaaaattataaaagtaccttaagaaaattcaaaactcttgtgtgtcctttataggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgat

SEQ ID NO: 48178 - DNA, 220 bp, Homo sapiens
gcggccgcctactactactactgctcgaattcaagcttctaacgatgtacggggacatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgat

SEQ ID NO: 48179 - DNA, 2675 bp, Homo sapiens
aaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgataagattcttcatgcttctttgctctccttaaaatgtctttttcactagttagttccaagggtcagtctcataattttgttcttatactttgatttcctttttcttttttttttttttaatagagttgggggatctttctttctttttttttttttttttttgagatagagtctcgctctgttgcccaggctggagtgcagtggcgtgatctcagctcactgcaacctccacctcctggatacaagcgattctgctgcctcagtctcccgagtagctgggattacaggttcccgccaccatgcccagctaatttttgtatttttagtagagacggggtttcaccatcttggtcaggctggtctcgaactcctgacctcgtgatccacctgcctcggcatcacaaaatgctgggattacaggcatgagccaccgcgtccagcctagagttgggggtctttctatgttgcccaggctggtcttgaactccgggcctctagcaagcctctcatctcagcctcccaaggtgctggaattacaggtgtgagccactgcaccatactttggtttcttagcaggagattttggttcacagtaacccagctctctttcatctaagaactttagatgagaaaaaaaaaaaatagactacagataactattcccaggcagttatggtacatttagccaacacttttgcctcttctcatgttatctgttagtattaatgctgacaaagcaagattttttgcgaaacaacacaccaagccttgcttttacactgcattcctcaggaggttgtttattgtgttgttgattttctttcccttttgaatatgagatatcagagtaagaaaactctgatcagagttttctgaaaactcttatcagagtaagaaaaatttgatcaatgatcaaattcagtgactcaattttggttaaattttatccatcaatagatggataaaagtgtaaaatgatttttttcacatttcttgtcccatttgatccgtcagcatcattttgccctgatgaaaatctcacttcctaatttcccctagttctcctcctacacttctgattccatttcatttgttggggtgggggaagtaagaggcaaaactatttatcttatacacttattgtgaaatctcagtgagaacaaagtgtcaaagcacctggaacttagtaggcactcaacaaattcaagcactctgccctttcctccacttaccctatagctgtgggtgctttgcagggttctagcttgagtccactcctttcacatctcacgttcctagatagcatcatctactcccatggttctaactgcctcttaggaccccaaagtctgtacttccagtttctcccttactattgatcttcagaatgtctctcttgctagctgtgaaaatgagtccatctggatgtcccctagaccttgtctacccaacaagtccaatgatatcacttagttgttcaaggtgaaaaatccaggtaccaatgacccctgaattgcctcatcgcacctttctccttttccccgatatccaatcagacacccactctgtcaccgatactccacttgaaagccccaaggggtgatctattttgtttgctgctgtattcccagtgcctagaacaatgcctgacaccagtaggtatctactcaatcattttgtttgctgctgtattcccagtgcctagaacaatgcctgacaccagtaggtatctactcaatcacttattgaatgaattaatctgtcctctcctctttgctgacataaatgtagtccaaaccttattacctctttggcaaatcatgttcataccctctaaactaaccttcctgcctactagcttgggatcctcaagaatcagctata

SEQ ID NO: 48180 - DNA, 1533 bp, Homo sapiens
aaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgataaaacaacacaaaaaaaaaacaacaaaaacacaaaaacaaacacaaaacaaacaaacaaacaaaaacaaacacacaaacacaagaacaaaaacaaagaaacaacaaaagagggcggcagcgcgggcgaccacacaaacgaccacccacaagcgagggggggcacagaatcgatatgacgcagaggagccacgcatgtattatgaagcaaaaaggcgggacacaaactgcaagcgcaacgaaattaatcaaacgacagagcagcccgacagacacataaaaaacaaaacacatgaaatgaaacaaaacaacccatacgcccgaaccaccaaaagggaagcaaacaaacacacaccacagccgagggagcgagacacactgcagagaaccacccacacagaaaaagaaaagccgacgaagagaaaacaaacacaacaccggcgagacaacgaggaggaacaaaaagccacgcgacataagagaaggcgacaagagaagaagaaacgaaacgagagaacgactagagcaaaacagagaaaatattaaacgcaggggcgcacaaaaaaaacaagccgagccagcgtgcaaccgaagaccaaccagaagcagactaaactgcaaccgacacacgacaccaccagcgcgccacccaccccgcaacccagcaacccaaccgcacccgcccacagccccaccacactcacccagccgcaccacacgcagcgccacacggccgacccccc

SEQ ID NO: 48181 - DNA, 806 bp, Homo sapiens
aaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgccgctttttgcagctgccttatcacaacactgatcccgttgcgttgatggaagcactgtgaccctggctgacagcaccacaactgccaggacagacaccacagggggcgtggcacagcaacctgggccatctggtacgtcagcgctgacgtcagtcttgggccttgcaggtgggaggtggaaactcgagtctggaggttggccatggtggtgc

SEQ ID NO: 48182 - DNA, 419 bp, Homo sapiens
tgtctgtgtggaacaagcgtcgcaatgaggactctctacaggacccgatatggcatccctgtgagtctcttaccataccatctcactcaaatatgcaccccattcaaaataattattataaacatggagatcatttgatgtatacatcttctgaaattgattgataagagttccctagcatgtgcaatcttgcattcagttgtagcaacagatcttctggttatgtggcctccttctaggtttctgctgaaaacctgagaaaattgataactcatatttgcaatggatgtcataccatggaagaggcttatttaggatctactgtggcgtggatgcattacatgtattatctcacttaatcctcacatcatctctgtaaagtgggtaggtccacaacattttgccaaagagaactttaa

SEQ ID NO: 48183 - DNA, 792 bp, Homo sapiens
aaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgat

SEQ ID NO: 48184 - DNA, 933 bp, Homo sapiens
cgccccggcgaatggtcccccgagggcagccatccgcagacgcagttccctgattgccccagcaaaaatgggcggtctccttgggatagattctgcgcgggctgctcttaagaatttaccggcaggcaggtctggtcccagcagaggagacccaggggtcccagagctgggctggcgggaggcgtaatccggcggggtgagggttgatcgaagagccccgcgcgcagctgccgctcacagccccttcccgagtgcagagcgggcagagaagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttactgat

SEQ ID NO: 48185 - DNA, 374 bp, Homo sapiens
aagcagtagcacctgttttactgggttatgctgaaaattaaatgagttgctacatgtaatgtgttaataaccgttctaggacacatgtgctcaaggaatgtgggtaggataatgatgtgatggtggtggtagtatttggttgatgtcatagggtaagtacttctatattttgttattatctaagcatttcattttattaaatatttttctccataattgctttcttgaaatgtaagagttaagtcctctcatagaaatattttggtcacttaacatagtcacattaagtaatattttttaaaaagaagcttagtaagtaagacaatttgatcccttgcattagttttttacaggttttttttttttccttttga

SEQ ID NO: 48186 - DNA, 1316 bp, Homo sapiens
ggcaacttccggcggcgggagctgcagagcgcaaggcgcgcccactgcgcgtgcgcttcggcccggctcctcctgcgcccccggcccctgcgactgggacttggtacggccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatattgtaagtattttttaatcttcagagaataaaaataatttaaaattcttcttttttaaaagaaagttcttattattggttctttggattcattttatgtttaaatgtttaagtgatctttaaatgtttaatatgattttaaaaattattttgttcagaagaagtccatttctctatctgcagttttctgatgtgaaataaaaatggaaatcttgtaattactattagcagtaaatatttgacttattagatatgacccatttttaaattgttaataaatatagttcagttattaacaaagctatgcatacaacagaatatcctgtaatgttatttgatatagagagaatttaagcataaaacaggatttttatctcatgtaggatatttggttgcagaaatactaaaatagtatagcaactttatttacaagatagtcctgaagtacatgctatataggaagagcactttgaaattttggggtgttctttttcttatggtgcacttctttcatgtacttcaaagcaataaaaaaaaatgggtgatctcagggctgtttttattgtccctgctcttttacaggctcattttattgtggtcataatacagaacaagaaggaactcc

SEQ ID NO: 48187 - DNA, 876 bp, Homo sapiens
ggcaacttccggcggcgggagctgcagagcgcaaggcgcgcccactgcgcgtgcgcttcggcccggctcctcctgcgcccccggcccctgcgactgggacttggtacggccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatggttagtaacatagtttacctgtggcttttaatgtacttaaatatgtaaatttaaaacacagtataatttaagcttaagtaccaatgtcaaatcaccaaactgttttaaaaaacaaatacactgaagtagcagctgacatcataaacagtttgccgacacagctcagagtgaacttaggcagcagcttttattgggctgttgtgttcaatatgtaattataaaatgaaaattatccagaagcaatgactgagggagcattttaagaagaaagtaccaatattgatagaaatgtagagtaagaaaattaattgcttagaaatatgctaatataaaggtactagctgtgagacatggaaactcaagtatagaaattgagatgagtgagcagcaaaattataaagagataaaacctt

SEQ ID NO: 48188 - DNA, 829 bp, Homo sapiens
caaatggcaagatctccttttttaaggcagaatggttgtccgttgtgtgtgtgtatacacacgtagcttattttctttatctgttttaccattgatggacataccttggcgattgtgaataatgctgcattcttatagtttcttcaatatcttggctattgtgaataatgctgcaatgaacaggggagtgcagataacttcacaaggtaatgattttactccttccagtataaacccagaagaaggactgctggatcatgtagtagtttcccttttaatttctttaggaacctctatactgctttccataatgactccgccagcagtgtactagggttcccttttctccataccctcgtcaacaatttatctcatgcctttttgataatagccatccttatgggtgtgaagtagtatctcatagtggttttaatttgcattttcctgatgttaaatgctgattttaaatgttacataaacataaaagaatggtataattttattttctactgagttaaatttccaacattatgaatgcccttgtttttagtaatgaagcagggccagactttcagataaaggtggaagtatatagttgctgtacagaagaatcttctataaccaacacaccaaaaaagctagctaagaaactcaagacatctataagtaaagctacaggaaagaaacataagttcagtgcttcaagaagaggatgatgaaatgtgcttgctcctcagctctgctgtatcaggtgtaaagtataatctgctagctcacactaccctaaccttggaaagtgctgaggatagtatcaagacccataatctga

SEQ ID NO: 48189 - DNA, 683 bp, Homo sapiens
tccccccatgcgccccgccttccagagcgcaaatacctcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtatatagttgctgtacagaagaatcttctataaccaacacaccaaaaaagctagctaagaaactcaagacatctataagtaaagctacaggaaagaaacataagttcagtgcttcaagaagaggatgatgaaatgtgcttgctcctcagctctgctgtatcaggtgtaaagtataatctgctagctcacactaccctaaccttggaaagtgctgaggatagtatcaagacccataatctga

SEQ ID NO: 48190 - DNA, 736 bp, Homo sapiens
attcttggagagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatgttaattctaaaaggaactaaaatagaaacatgatgtggtttagactcaggtattaaaaaatgagccatctcagaagtggagacaactgaatatcttcc

SEQ ID NO: 48191 - DNA, 995 bp, Homo sapiens
attcttggagagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatggttttcgattccctgccccctgcccgaggacctgcctcctccctgcccgaggaccaagcttcagaagaactgcacatgggaggaaataccaaccgcttaacttcttcagagacaacctctaacccggctcaccaccacgctagctaaaaaagggccctctcccagggaagatcccggaggaagagtgggaattcaccctccccttgggggaggagtgctttctctacccttaatttatgaactgagaaaaatcctaacaagcctactatgaaataaagatgcccttaacccatttatgcctagtgttccattattggaacgctaagcttgtgggagttatttatatcctactgctca

SEQ ID NO: 48192 - DNA, 964 bp, Homo sapiens
attcttggagagaacttctccaccgaccccgtcacctggattggatcaccgacctctcccaagaggggcctggcttcctcctcgctggggaaacggtagggagctcccctaggtaaagcctctagggagagtggccaggagccgggtcaggaaaggctctggtgcccaaagggctgcccgcagaggctgaggtccctgcaagtgcacagggaggagaggtgagatcagattccagccgagtcaggcttccatgtcagactgcgtgtgtttatgcagaggtgcaactcaggaattactgaggagaaagtacagggccaatttaacctcctctgagagacctctaaccctgctcatcaccactcctcgctaaaaagggccctctccagggaagaacccagagggagagcgggaattctcctccccttggaggaagagtgcttcctctacccttaatgtatcaactgacaacaattcaaacagaaggaaactaggatgtgacaaataaaggaagccttttcatgctctatgtccactggcgtcgggcaagccccggtggaagtccaaggaaaagagtctaagacccaaacagatggtttgcgccaaagttctgaagtgtatcagacgtgaataaaggtatgctgcctcctccctgcccgaggaccaagcttcagaagaactgcacatgggaggaaataccaaccgcttaacttcttcagagacaacctctaacccggctcaccaccacgctagctaaaaaagggccctctcccagggaagatcccggaggaagagtgggaattcaccctccccttgggggaggagtgctttctctacccttaatttatgaactgagaaaaatcctaacaagcctactatgaaataaagatgcccttaacccatttatgcctagtgttccattattggaacgctaagcttgtgggagttatttatatcctactgctca

SEQ ID NO: 48193 - DNA, 484 bp, Homo sapiens
tcggaagatgaccctgggcttgtcttcacattttccgtgttgtcacttgccggtcctttggaagccgtccctagatgtacactgtcttgccgggacctttctcttctcttcccctgtgaccacgcaggttttcgattccctgccccctgcccgaggacctgcctcctccctgcccgaggaccaagcttcagaagaactgcacatgggaggaaataccaaccgcttaacttcttcagagacaacctctaacccggctcaccaccacgctagctaaaaaagggccctctcccagggaagatcccggaggaagagtgggaattcaccctccccttgggggaggagtgctttctctacccttaatttatgaactgagaaaaatcctaacaagcctactatgaaataaagatgcccttaacccatttatgcctagtgttccattattggaacgctaagcttgtgggagttatttatatcctactgctca

SEQ ID NO: 48194 - DNA, 707 bp, Homo sapiens
ctttaacatgcttgcttattttaaaggtttcaaatcatacttaagctcagcgtactattgcttttgagagatagttcgaatataacaaggttttaaagcagaaacagaacccagtttgcccacacccctgcagggctggaatgtctgtcagcagagctgagcttcaccacctacaggtccctgaagcctcatgacccagtttgaaattgcagccctactcttggtgtctctagagccctcctctttcccttggagttataatttccctctcgggtttgtcttgactggtgggtgttcaatgtagagacacacaggaaggaagcaaatgtgccatggctggtggctgctggtgagggcgttttcgtaggaaagtatgcaggagccagttttatttcaagagcctcctgaaatataacaggtcaaatgggtgattggtattttctggaacagactccaaatctacacgtttcactcagcttctgcatttgtgaaatgatggggatttgtgcattcattcattcaacctaactgtattgagtactcaaatgccagacttcacatgttttaagctcaagaaacatgttccttttttcagatacagacttgaaaaacctgatcaagctgtatctggtttcagatggcagtctgaaggaatatttactttttgacctcttcaaattttactatcaacagcaacaaaaaaaaaa

SEQ ID NO: 48195 - DNA, 549 bp, Homo sapiens
gacagagctatggctagggcttcttagctccctctccttctaggccagggggagctgcacagggtggcagtcacggagtgaatcctgccaccagccagctgtgtggcacaggtatcttgggccactagggtgagcatagtatggatggctctgtcggaatccatcacacctggggaaaaacatcccaaagggcaggtcccatgatcgtggtgcgaataaggtgtttaatttttcctttcctttttagacatctgctcccaagtacacttttatgaaaagcacagccacctctatgagtgatttccactgtctagtcggcatatgaagcgactgtgctcaaaggagtaggtagtcgtagataaggctatttaaaataaaaatttcggagcatcagggcaaagagaatattgcatttggttaagaggaggtcagctgtgagagtccattaaaagggaacagactgctggtgacttttgcaggaagtaggagagttagaaagggacttgcagcatactgaggctagctattgtctttccactatcagttgcc

SEQ ID NO: 48196 - DNA, 434 bp, Homo sapiens
ctaggctttgtttgaagctctttgcagcaaagtagatgatacaaaaatgtatgtaactaaaataagctaaatgatgggagttatttgattattccttttgttaggtgtatgtaggaactacactctaaattaaaggcactgtgttttaagtcgatctgtgaactcctttgctgaaatgctttttaaagtgaatttttgtgtctcttcatgcttgatgtttcatagtaccccctcgaggggtacccgtctgcttccaagcacttgtctgggtagcggaaagaatatctttatttcacacctacacgccatggatcttttaaaggatgttgttggttacttttacttcatctgccatgacttccatagttctgttctttgataaagatgtgctccttagggtgctcaatagatttctttcaaaagccactgtttac

SEQ ID NO: 48197 - DNA, 259 bp, Homo sapiens
caccccctaaccagtctccttgttcctgcccctgccactatcagcttgttctcaatgctgctaccaaaacgtgactcaaatcatgccattcctgtaccaaaaaaaaccttcacagctcccatcccattcatagtggaagttccagttctaaaatgtccgtcattctctctctggcatctctcactagtctccctgctgactcctatcaagccacatagttctccgtgttatcctccctctaacttctataaggacaggg

SEQ ID NO: 48198 - DNA, 558 bp, Homo sapiens
ctgagccaaagggccagcctgatgggaataagcaggaggaagagtgaaaggagtagaagggatgggaggaaggcttggtggcagggcagacagcactcgggattgagtgaagagtaatggaagttccctgagagaaggtgagtgctccaatctgataacaaccacagtacagcatcgtgtatgttcaagatattgtgctaggcccttggggcgatgcaaaggggtgagacatggagcctgctctacagctgagtcgggcaacagaactggcatacttaagaggtgagcaagaagcctgtaatcccagcacgttgggaggccgatacaggaggatctcccaaggccaggagttggagaccagcctgggcaacagagagacctggtctccacaaaaaatacaaaaattacccaggagtgttggcatgcgcctgtggtcccagctactcgggaggccaaggtgggaggatcacttgaggcctggaatttgagactagcctgggcaacatggtgaaaccccatctctaaaaaaaagtttttaattagatgggcatggtagca

SEQ ID NO: 48199 - DNA, 349 bp, Homo sapiens
tgtatattgagctctggagagtgataagacacacttctgctggggaggccccactggagcgcattgcatgtgggatctctgccttcctgctacttggttacatttaaccacccaagagtgggtcatgactgaagagcctttttctactcctaggctggatatagcctgatgtgtagattttgcccactaacccattttgtttgatctgatttaaaaatcatttgatcaaggctgggcgttggcggctcatgcctgtaatcccagcattttgagaggccaaggtgggtggatcacctgagctcaggagctcgagaccagcctgggcaacatggtgaaactccgtctctaa

SEQ ID NO: 48200 - DNA, 420 bp, Homo sapiens
cccgccttggcctcccaaagtgctgggattacaggcatgagccaccacgcccggcctatcaactaattttaaaactttcgattgtaaccgctgatcaaacgtatcagattgacttagttcagttttaaagtcagcggatccagctaaaactagaccagccaccttccctttgtccccagaaataaacagctgcacagcagtctctgctactttctgaacattgttaggtcacttttccattcttaaacaggcaaaacgcaaggctgactgacctttaccgtgtttctttgggagatccacagtgagtttttgcaggacttctcttgtgtttccttggagggtgccaaaaagtgcaccactaccatctattacgatgaatccagacttgctttcatctgaaagtagtgctgtaagagcttc

SEQ ID NO: 48201 - DNA, 624 bp, Homo sapiens
tcgaagtaatgacgttaattccctgggaaacactcagccacagctgaaatgtgtgctcttcaggatggtctccagatccgcatcatcccctagacagtggggtcccggaaatactcatcacctgttcaggaattcaggcatcaagtggttcgtagggagagttcagcttgtaagcttctattcttttggttaatattaaaattagctagttttgaaacttagccataaccccatgtaattctaccagtggtgaacaagatattaatttaaaacatatcctgtggctgaactcagtttatgtcatgagaattgtcgtgatattctctggtttagctaactcaccgtaggggctgggcacggtggctcatgcctgtaatcccagcaccctgggtcaccgaagcaggaggattgcttgagagcctgggagtttgagaccagcctgcgcaacatagtagtgagactccatcccaaggaaaaaaaatagccaagcatgctggtgctagcctgtggttgcccctactccagaggatgaggtgggaggattgcttgagctgggaggttgaggctgctgtgagccctgccactgcaccactccagcctggctaacagaccttgtctcttaaa

SEQ ID NO: 48202 - DNA, 566 bp, Homo sapiens
actcagtttaaaagaacaaaaaccaaagaaatctgaaaagcttacaacgaaaagacgctcagtattctcttctcctccctggattagctgggtgggcgccaggtcatcacagggtccttgtaagaggaaggcaaggggtcagagtcgggcagaggaagccaaggtcagaggggaggagaggctgctgactttgaagatggaagagaggcctgagccaaggggtgcagcggatcctagaaatggtaagagggacacagatcctcccctagcgcctccaggaggagtggaacccagccaacacctggatcggagcttctgacctccagggctataggagaataaatgtgtgttgctgaagccactgactagtcagctactgcaaccgttggaaactacagctattatcacaatgcccataaaacacgctccagcagcgtgagaacaaagacagttgtgtggtggttatgaaacctcacctaacaagaccatgtttaagaaaagccaaataaaaacaagaagtaattatttaagcggtatcctaataaatggcttgcaaaaatatgtga

SEQ ID NO: 48203 - DNA, 396 bp, Homo sapiens
  misc_feature (282)..(282): n is a, c, g, or t
  misc_feature (387)..(387): n is a, c, g, or t
ggtcaagaagcaatggtcaatgtctttctcactctccagtctttctcctcatctagccaggaaggaaggttgagatatgaccatgaggcaagaacacatactagcgtggtggaggcaaagatataaggagtctgggtctctaatgactacaaaaaacccctcattataccagcccagggtgtggctgtctgcagacacttcattatatacaaaaaataagctaattacccccctctactaaaaatacaaaattagctgggcgtattggcacatgcctgtaantccagttactcgggaagctgaggcaggtgaatggcatgaacctgggagacagaggttgcagtgagctgagatggcgccattgcattctagcctgggcaatgagantgaaactcc

SEQ ID NO: 48204 - DNA, 314 bp, Homo sapiens
cccaccactactcctgatcccaccacgacccctcaccccacaactcctgacccttcctcaacccctgtcatcactactgtgtcccttccaacctccttggggacagaactctcctctcccactctagcaccaacagtcaagcccagtctgcacccccagttgaccttcacagcacctgcccctcacaccaccactaccccagaggaagaagaaagacccctgaggggagacgtgtgaccctctccaggatttgaggggcttaagacacccccaaccaaaaaaaacaaaaacaaaaaaaacccccaaagtatcta

SEQ ID NO: 48205 - DNA, 863 bp, Homo sapiens
cccaccactactcctgatcccaccacgacccctcaccccacaactcctgacccttcctcaacccctgtcatcactactgtgtcccttccaacctccttggggacagaactctcctctcccactctagcaccaacagtcaagcccagtctgcacccccagttgaccttcacagcacctgcccctcacacctccacatcccagatacccaccttagagccctctccagccttggagtccagcccctccaggtcctccacagccacaagcatggacccactgtccactgaggacttcaagccacccagaagccagagccccaacctaacccctccacccacccataccccacactcagcctctgaccttactgtgtcccctgaccccctcctttcccccacagcccaccccttggatcatcctccccttgaccccctcaccctagggccaactcctggtcagagcccaggcccccatggtccatgtgtggccccaacaccacctgtaagggtcatggcttgtgagccacctgccctggtggagctggtggctgctgtgagggatgtgggtggtcagctgcagagactgacccaggtcgtggaacaggagcggcaggagcgccaagccctgctgctggggctgacgcagctggtagaagctgcccggggtctggggcagctgggtgaggctgtgaagagactggcagagatggcctggaccaccagcatgcctgcaccaaccaccactaccccagaggaagaagaaagacccctgaggggagacgtgtgaccctctccaggatttgaggggcttaagacacccccaaccaaaaaaaacaaaaacaaaaaaaacccccaaagtatcta

SEQ ID NO: 48206 - DNA, 423 bp, Homo sapiens
tctaagccttagattttggagatacaaagaggagtgatacaaacctagctctttccccaggaagctgccttgataactagttttctattggtttctgattgaaagttttcagtttcattgattttagaatttaacttcagaatatgacatctgaccttccatatcttagaaacctgttattccttttttttagtctctgcattgtctttgatgccttggtagcatgcactgaaaattaactcttctgtttgaagctgtaattgtcaagattaaagattaactttttatctttgagttcactttaggcattgatctcttaggtgacagtgcccttgatgaaaaacagataaggggggcacaagcttataaacgtcaagtgaaagtaaatgctgcaggaactcatgttgtttttttaaccaacat

SEQ ID NO: 48207 - DNA, 350 bp, Homo sapiens
tgcatgacaaaattaccattttagggtatacgattcagtggcatttagtccattcacaatgttgtacaaccaccatctctctctagttccaagacatttcatcactccaaaaggaaaccttgttgtacattaatgggcactccccatttcccctttcctccagcccctggcaagcaacaatctgctttctgtcacaacagatttacttattctaagggtttcatataaatggaatcattcacttagcattatgttcttaaggtttatccaagttgtagcacatatcagtactttatcattttatggccaaataatatttcattgtaggtatataacatattttgtttatc

SEQ ID NO: 48208 - DNA, 544 bp, Homo sapiens
tctaccacaatgcagcttctacctcctcaccccagatgttcgctgatattcttgctgccaaatttgatggatataccatagtgcttaccttactttacctttgttgaccacttccttctttttaaaatgcttctgtgataccattctcctgtggtttttctttttacctttctgcttgctgcttttcaggcatgttttctgtctcttagaggtcaaagaatcttcacataggccttctcgtcacttactcttcttgggtgttctcatctttgtggcttcaatttttgtctctatgcttatgtcttccaaatccctatctgtagcccatgtctctcttctgaactttagatccacatttctccaatgggccatgattagttactcttctctccaggcctttgcattattgttggaacattctttcctccttttttccattctcttcctcttcctgctcagccaacattgactcagcctttcataacctctcagatctgggttaggcacataaccagagtaccctgccacagcactcatcacacag

SEQ ID NO: 48209 - DNA, 339 bp, Homo sapiens
tgatccatttgggatcctgaggcttagatctttccacagttgttttttgggtttggggggctttcttttccctctgtctctctctctcctctctctctcttttttctctttctctgtctctttctttttccctcagcagattctcattctctatcctctcccctcccctccccacatttctttctttcagaaatttttaaatgctggccaggtgcgatggctcacaactataatcctagcactttagtaggccgaagtgggcagatcatttgaggccaggagtttgaggtttgagaccaacatggtgaaaccccatctctactaaaaaattagccaggc

SEQ ID NO: 48210 - DNA, 2630 bp, Homo sapiens
ggtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagttctcaacccttataacacataagaaaattcatactggagagaaaccctacatttgtgaagaatgtggcaaagcctttaagtactcctctgcccttaatacacataagagaattcatactggagagaaaccatacaagtgtgataaatgtgacaaagcctttattgcatcctcaacccttagtaaacatgagatcattcatactggaaagaaaccctacaagtgtgaagaatgtggcaaagcttttaaccaatcctcgacacttactaaacataagaaaattcatactggagagaaaccctacaaatgtgaagaatgtggcaaagcttttaaccaatcctcaacacttactaaacataagaaaattcatactggagagaagccctacgtttgtgaagaatgtggcaaagcctttaagtactcccgtatccttactacacataagagaattcatactgaagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttaagtactcctctacccttagttcacataagagaagtcatactggagagaaaccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaatccattctggagagaaaccatacgagtgtgataaatgtggcaaagcctttatttcaccctcaagccttagtagacatgagataattcatactggggagaaaccctagaagtgtgaagaatgtggcaaagccttcaagtggtcctcacaccttactatacactgagagttctgaacttactctgtaaccatcccaaactcctcccaggcacagtctggcagaggtcctgccatttcggagacctggaggaagtggcccatttacagccatgtaggcaggcctgcagaccttggcctttactacggtacctgaagtggttcaatgactcagtttcagttacctgagccacagcttaaggtcagttctgcctatatagaaacccacacagttaacctgaggaaatgctctctggtactcactgaaagccacactcatccacatcctgatacaaggcccaccatatgcagacctgactgccaaaacatgccctagtgtctgccgtacagagtgaagtcctgaaggatatttagtctgtccaaaactaaaatgaagatttcaactccccaaccccctctaacaagccagctaaaggtggactatagtgcagacccagcaaccttgtgaccaggctaaaacccctcatcactacaaattcagagggcatctcatcaccctaagggcccaacgaaagatctttaccttctaacatcagtttatgaaaacttgaaaaggtgtttgctccatcaaattcagacaccagtacaaaactatattatgcccattgtctggttctattttaatgtagcactggaagtgtgtggcagaagaattagtcaaagaaataaaaatagccattgaaattgaaaaaaatgttgctgtttgtagatcatacaatcttatatttgaaaaaccttaaacagtacattaaaacccgtctaaactaataaatacactcagtaaattaacaaaatataaaatcaaca

SEQ ID NO: 48211 - DNA, 849 bp, Homo sapiens
ggtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcaggtgcacgcctgttatcccagcactttgggaggccaaggtgggtggatcccgaggtcaggagatcgagaccatctggccaacatggtgaaatcccatctctactaaaatacaaaaaattagccaggcatggtggcccatgcctgtagtacgagctactcaggaggttgaggcaggggaatcactagaacccaggaggcactccagcctgggagacagagtgagactccatctcaaaatatatatatatttccaaatattcagtttggtcttattatattgacattgttatgcaacatatcactagagtgttttttatcttgcaaagctaaatctcagtacacagtaaataactaccaatcctttgtattttgtggttcttttcaaacaccactctgttttctgtttctaagagtataactgctttatatatctcatccatctctgtctttttgcggctgggtcactttattttgcataat

SEQ ID NO: 48212 - DNA, 433 bp, Homo sapiens
catgataaactttattaggaaaaactaacgcttatggagtttctgtggagagagcagtccccccaaaagtccattctcacttttttatttctacctttgattctcccattgctccaattcaaatcatgctcattcagaatccctctttttccataatgccttatttacttactgtgtcagccttaagggtctgatttgaagctatggatagtttggtgatcaaaacctcacaaagtaggccagagaccatacttttcacctctcattttctgtaactttggcaagtgtcttaatcagtgccctattttacatatggggacaatagtacctcccatagttccctaggttgttctgaggaatgcatactaagtccttgacatgatgtgttgtaagcccttagtaattgttaactcttctactattatttcttcca

SEQ ID NO: 48213 - DNA, 298 bp, Homo sapiens
tttttttttttttacaaatcttagattttatgaacacttgctaatagcccccccctcctagatcgtcattgctgtgtaacaaattgtcatacatttagcagtttaaaataccacacatttactcacagcttccatgggccacgagtgtggggacgagtgactgggtcgtctgctcagggtctcttacaagactccatcagcgtttcagctggggctggggtctcatctgaggctcagggtcctcactccaggtcacagggcagaattcatttctttcaagctacggatctcatggcag

SEQ ID NO: 48214 - DNA, 350 bp, Homo sapiens
aactgtcaaaatttagtgaggaacaaagttatgaaattgtgtacatttcttcttacctaccacaaggaaaaatagcttaatacaggcagcaagaaggaagcataagatgcagaagggactaggatagcctcaaaattagtcactatctctgaataataggagtgactagatggcaagtggaaataacctggagggatgaggggatttaaatagaatattttgtaaaagaatctttatatttttgaggaaaatacaattgtagtaaatagtgtattcattatgtttcagagagcgatgagtttaaaggattttgggttatcttactatttgcagttttaataagatggtat

SEQ ID NO: 48215 - DNA, 1212 bp, Homo sapiens
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaagcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtaaaattttgtcatatacccagcttcagataccatgcaatgatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctcaccaaaaaaaaaa

SEQ ID NO: 48216 - DNA, 776 bp, Homo sapiens
tagatgtaatgcacccactgtaaaactgacttaagcattaaagcgattccatttttttcctcactgggccaaaaacaatctctggttcttttgtctttagtggatctgctatggcagatgactttattttaatctgtttttaaaaaatattactctgaaagagaaaataaactgttctcaaggaaatggatatatagtatctgaggaccacagcattgaaggatatgaattaatagtttagtaactttttattgcaggtagtacttgtgatttcggccagaaactggtctgtgctgataaagtacttgacattgactgattcattcatattcatgtagtaagtattaattgaatatgtaggttcgaagcattcattatgctaggtgctggtactttctgaacttccccaatctataactttttttaaaaaatgtttttattgcgcttgtataatataatattaaagttcctggaaatgtttattttaaatggctaggaatacaacatgttcattgtgtgttggagaagtagggatatttcaacattgcatgttaaaaataaatggcctcctttctcaacttgctacttaatgtgaaaaagggaggggaaagattataaatatattcaaaccagttattcacatgggtatatgaagtacccactatatcctcctgacagccttgttaattacatttatacttctgtggtttacctaggtaacatttctcacttaaactatgtaccctcttaaaccattcctctattagtatactgac

SEQ ID NO: 48217 - DNA, 485 bp, Homo sapiens
agccaaaaatgccatttttgtctttcaaaatgacagtgattaaaacattttaatgctttgaatttgtgcccataaaaatactttctcaccagcacatacatttcttgtataagctaaaagtggtattccctttctaaaaaatgccagcaatgttctttctatttggcccagtaaataaattaataatggtcatattctttggtccagtaaattaaacttcagaacacttattataagaaaatagaggctggacacagtggttcacacctgtaatcccaatactttgggaggccaaagtgggtggatctcttgagtccaggagtttaagaccaacccgagtgacatggcgaaaccccatctctacaaaaaatacaaaaattagccaggcgtggtggcacttgcttgtattctcagctacttgggagactgaggcaggagaatcacttgaacccgggaggcggaggttgcagtgagccgagatagtg

SEQ ID NO: 48218 - DNA, 263 bp, Homo sapiens
agaagaccaattctgtccacagtgtatgaatgttctaggtgaagctggggtgatggggagagtgaggtgaagacaacatctacaaatctcatgactttttgttgttgttgttttgtttcattttttggagacagaatctctgtcacctaggctggagcacagtggcgtgaccttggctcattgcaacttctgtgtcctgggttcaagcaattctcctgcctcagcctcctgagtagctgggattacaggcgcatgccctgcta

SEQ ID NO: 48219 - DNA, 650 bp, Homo sapiens
aagaatggaggcttcttaagcccatgggctcatcttacaggaatgtgcctgttttgtatttcagggtgttctagaaaattgctttcttgagcaaaaaggagaaagtttttcatgtcctcatttgaccacattttgttcccatggctttaagttgaaagctcagaatcagctctactctcatcactaggtggcacttgtgaattacaaatagtcaaatgaatttttatgacaaacatgtgattcacaaatatagataatgtttggaatccctgcatggacgttcctcaaaatggaagaaatgaaagaaggggattcctagtaagtaccagttgctgtgatgtatttataaatacatggttgaagaataaattacttcataatcatttcgtatttaatagtaatatcaataggtaaagtctggtctccatgcctgtgttcttaaactaatgttgccacaaagttgaaatttttttaggacctgcttgctattcatcttagttaattgcaagagaagtgagtactacaggtcaggtgcagtggctcacacctgtaatcccagcactttgggaggctgaggcagggcgattacttgagttcagggattcaggaccaacctgggcaacatagtgggatcccatctctacccaaaa

SEQ ID NO: 48220 - DNA, 426 bp, Homo sapiens
tgtagagacaaggtttcaccatgttgcccaggctggtcttgaactcctgggctcacgcagtctgcccacctcagcctcccgcaatctgcccacctcggcctcccaaagtgccgggattacaggtgtgagccactgcgcctggccacagctagtttaaatacaaagaatccagtaggttaaaggatagaaaaagatatccctgtgataacactaatcaaaagaaagttggggtaataatagacaaaatcgatttcagagcaaagtatataaacagggaaaacgagggttatttcacaatgatgaaagggtcaattaagaggatatacggtcctaatatttatgcacctaattagaaagcttaaaattcatatgcaaaaacttgcagaactgcaagaagaaatagataaatttatacaagtgttgtca

SEQ ID NO: 48221 - DNA, 347 bp, Homo sapiens
tcaatatactccagggactaagacaacaaaatagagttaggcttcctgccactgaggctgaaggcccaatggagtttttaaatattgctatgacagtggtggccacaaaacaggatgactaggtccaaagggagtctcagcttcctccaagtacaagtgcggttgtttcaagggtgagaaacttcacataccaaaaacaaaaacaaaagagagccttggatgagctcagagacactcttgtcaccagccactttggtgacattggctaggtaaggtgattctacctccccagcttcagtgtttaccaaacctcagttatccctgtaaccacctgggctgtttctttg

SEQ ID NO: 48222 - DNA, 358 bp, Homo sapiens
ggaatttcttagaaagagtatgataccagaccaaaaacttggatctacacaaagaagtgaaaagcactggaaagggaataaatgaagataaaataaattctattttttaatttttaaaattaatcataaagataatggactaaagcaaaaccagcaaactggatttatagcatatataaaagtaatctttgtgacaacaatactacagagggtgggaggaagttattgggaatatactattagttccttatactgtatttgaaacagtattttattatttggaggtagacactgagtactcaagaatatatattggaaactttaggaaaacaattcgaaaatattttttaagtataaa

SEQ ID NO: 48223 - DNA, 423 bp, Homo sapiens
ggcacgaggatatgaaatcaaattagaagtattcaaacaccaatgctgctaacttaaaaagaagtgaaagtactgaaaagttgccttcagcactgtttgtgtctatctcttcaaccttttctagttaaaacaattttgtattgacatcaatgtgtgcacgttatttggatcccaactcaaacaaactatagagagaggaatgggggcagagattggaagtttgaacactgactgaatgttggatgaattatttttaaaaataagattactataattacccattttagataatccttaaagtgatcttgtcatgctgtcttgtttactcatgttttaggaattcgtgtattcatcgttaagtatgaactttagctcaatttggatctatcagtctttctatttaaacaccatatttgactgaaa

SEQ ID NO: 48224 - DNA, 281 bp, Homo sapiens
tactactactctactactactaaattcggcggccgcgtcgacgcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagagccaaagcttgcatctgaggtcgacc

SEQ ID NO: 48225 - DNA, 2199 bp, Homo sapiens
accttccatcttttcctcaacctccacttaatacttacaagtaattatttcatataataaaatagggataattgatttaaataataacaacaatgaaaaacagtgtagacaatacacatttttgaagcttttgcatgtatattctgcattagcaatgctttaggtctggaaaagtgtggattaacatataatttgctctgcctagtgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 48226 - DNA, 2526 bp, Homo sapiens
agtaccataatctgtctttgaaatctttctaatgatccaaggtaagtgggtagcctgttgtttccataactgaaattattacattaatatgtattaataacatagcacatggcaaatttgctctgatgagcccatcatttattaatacacattcattaagtgtaaaatttgaatctaggtcataagaacctaaggaatttgttaaagaaaattatcaaaaataaccaccaaaacccattgtatcttatagttgaggagctttcctcactatataaagattgtttttttttttcttagaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 48227 - DNA, 2442 bp, Homo sapiens
accttccatcttttcctcaacctccacttaatacttacaagtaattatttcatataataaaatagggataattgatttaaataataacaacaatgaaaaacagtgtagacaatacacatttttgaagcttttgcatgtatattctgcattagcaatgctttaggtctggaaaagtgtggattaacatataatttgctctgcctagtgtgttgttattagttttgttgaatgtgacactgtttctgaagctgtcaaagatagaacatgctgctcagtccttttaccgtctccgcctccaagaagagaaatctttaaagtaagtctttttccccctgacctgtattcaccatattatttcagtaattcttcagttgcagaaaacttaatttcagtttcagagactgtggtctgctaactatcctgtagccataaacagcctgtttttgtttgtttaattttgtgttttgtttgcaaatttatggggctctgatgatttctggaaatgaaaaaaagatcagaagctattctccagattttgaagatggcatttttctttcagtttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 48228 - DNA, 4158 bp, Homo sapiens
gccctttgatttaacctgactaatattgacagatgctttacccagatcattcttagagcttgatttctgaaacatggggagcttttgcagcaatttttattctgtatcgatggggcatcatccttgagataatagtaagtaatcttggtcctgaaatcattacaatttcatattgaattgctttatgttacttcctctattatgccaggcttctgttccttggtttttttttttttcttttctgtttggttcttctaagttaaattccttctggcggtataaaatagatgttaagtttatgtgctctggagctggagtgggttcaaattccaggtcagtcactcactagccatggagcctcagcaattatttctgtgattctgtttccccatctggaaataatgatgataataccacttatctcatagcattgcagtgagaataagatgagtcaatacttgtaaggtatgtagcacaatgtctaacatatagtaagcactatgtaagtatgggctattttatataatatttccagggcatatgagaataggtgagcaagatattgcttcttcatttgtcactagtagttttcaacatcactatgattatcaaattcccagaaaaaatgtaataattcattgggcatttgttagctctgatgaatacttttcagaaggatttcttagttcttttaatgtgtgatgttgaaaataggttgtgattacagtcattcttgtctttgggtagtgaacattaagtcaagttgaaacattattcaggctgataagctaagtgcagcagatattatagccattgataaattaatatttactgagtgagcattcagaggtagaagttgctaatttctatgttagatactatcttatgtgtctatattgtccttgtcccttttgaaatattcttttgagtgacatattatggccatttgataccattcaagtgaaatatttctgtatcttttgggttttgacagttgaaatattgattatatgtagtttagttaactatatattgttatgcatagttataggtcatacatatgtatatatttaattcctatttggagttttaatagtgtcctagaatgttctcctcattgtaatcatatttaaaaaccattttatgcccaaaataaaaaaagaaaaccccacgaaaccccctaaagccttaaaataaactttctttgatttcttctcttttggtttgtgtttctgtttttccagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctgaaaaaaaaaaaaggggggggtttaaatatcctagaggggccaagttaggtaccaggttctgtcaagtggcctatgtagtggataaagaagaggggggttaaagtcgaggaaagtgtggatttggagactcttgggggtatggacccaggttagcggaaaatggtagtgacgttgggaggata

SEQ ID NO: 48229 - DNA, 2408 bp, Homo sapiens
gccctttgatttaacctgactaatattgacagatgctttacccagatcattcttagagcttgatttctgaaacatggggagcttttgcagcaatttttattctgtatcgatggggcatcatccttgagataatagtaagtaatcttggtcctgaaatcattacaatttcatattgaattgctttatgttacttcctctattatgccaggcttctgttccttggtttttttttttttcttttctgtttggttcttctaagttaaattccttctggcggtataaaatagatgttaagtttatgtgctctggagctggagtgggttcaaattccaggtcagtcactcactagccatggagcctcagcaattatttctgtgattctgtttccccatctggaaataatgatgataataccacttatctcatagcattgcagtgagaataagatgagtcaatacttgtaaggtatgtagcacaatgtctaacatatagtaagcactatgtaagtatgggctattttatataatatttccagggcatatgagaataggtgagcaagatattgcttcttcatttgtcactagtagttttcaacatcactatgattatcaaattcccagaaaaaatgtaataattcattgggcatttgttagctctgatgaatacttttcagaaggatttcttagttcttttaatgtgtgatgttgaaaataggttgtgattacagtcattcttgtctttgggtagtgaacattaagtcaagttgaaacattattcaggctgataagctaagtgcagcagatattatagccattgataaattaatatttactgagtgagcattcagaggtagaagttgctaatttctatgttagatactatcttatgtgtctatattgtccttgtcccttttgaaatattcttttgagtgacatattatggccatttgataccattcaagtgaaatatttctgtatcttttgggttttgacagttgaaatattgattatatgtagtttagttaactatatattgttatgcatagttataggtcatacatatgtatatatttaattcctatttggagttttaatagtgtcctagaatgttctcctcattgtaatcatatttaaaaaccattttatgcccaaaataaaaaaagaaaaccccacgaaaccccctaaagccttaaaataaactttctttgatttcttctcttttggtttgtgtttctgtttttccagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggtagttgtcacctggtaaacagagatgaaagatttttactttagttatatgaagcagaatgtgcctcttgtttgtaagaatatgtcaggaggtctccttttcttccctcctttttggataatgtttatcaaactctgatttcctttaagataactaatatataagtataaaggagcagttgcaaaatggcaagcatataaccaatatattttatttggcccatgtgtcattttaagaattggacattaaactttttttaaaattttatttattttttctagatagggtctcgttctgttgcccatgctgtaagtggcacaatcatggctcagtgtaacctcgggctcctgggctcaagtgagcctcctgcctcagcctcctgagtagctgagattacaggtgtgcaccaccacacctggctaaaattggacctttttatataaaaactcagatctgacagtccagcactgaaatcccttcatg

SEQ ID NO: 48230 - DNA, 2777 bp, Homo sapiens
cggacgcgtgggcaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 48231 - DNA, 3977 bp, Homo sapiens
gccctttgatttaacctgactaatattgacagatgctttacccagatcattcttagagcttgatttctgaaacatggggagcttttgcagcaatttttattctgtatcgatggggcatcatccttgagataatagtaagtaatcttggtcctgaaatcattacaatttcatattgaattgctttatgttacttcctctattatgccaggcttctgttccttggtttttttttttttcttttctgtttggttcttctaagttaaattccttctggcggtataaaatagatgttaagtttatgtgctctggagctggagtgggttcaaattccaggtcagtcactcactagccatggagcctcagcaattatttctgtgattctgtttccccatctggaaataatgatgataataccacttatctcatagcattgcagtgagaataagatgagtcaatacttgtaaggtatgtagcacaatgtctaacatatagtaagcactatgtaagtatgggctattttatataatatttccagggcatatgagaataggtgagcaagatattgcttcttcatttgtcactagtagttttcaacatcactatgattatcaaattcccagaaaaaatgtaataattcattgggcatttgttagctctgatgaatacttttcagaaggatttcttagttcttttaatgtgtgatgttgaaaataggttgtgattacagtcattcttgtctttgggtagtgaacattaagtcaagttgaaacattattcaggctgataagctaagtgcagcagatattatagccattgataaattaatatttactgagtgagcattcagaggtagaagttgctaatttctatgttagatactatcttatgtgtctatattgtccttgtcccttttgaaatattcttttgagtgacatattatggccatttgataccattcaagtgaaatatttctgtatcttttgggttttgacagttgaaatattgattatatgtagtttagttaactatatattgttatgcatagttataggtcatacatatgtatatatttaattcctatttggagttttaatagtgtcctagaatgttctcctcattgtaatcatatttaaaaaccattttatgcccaaaataaaaaaagaaaaccccacgaaaccccctaaagccttaaaataaactttctttgatttcttctcttttggtttgtgtttctgtttttccagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaactttttgaatctgcatgttgatgatgattatcagaaagggtcttctgccatgctgtatctttatgaaagaaatagttgttttttcttaaggtaactatcagaggtgggattatcttgcctcctcacttagaataccaacagtcaaaaggaagaaccatcctctgagttttaaaaaccagaaggttatgttaaaatctgggcatttagtgacagatcaaatgcatacttgaactaagattggcttcagcttagcagtctttcatggtggaagtgacacatctggttgaaaataatttgtgtattttcagtaaccatgtatggcttccttctttatgtatgtgtgtgacttgttttgattggtaagttataagccagacatagattttagctctttaataaaaacttcaggggcacgtatgtcccagtacaagtgtactgactatcaagttttaactcagatgcaagctttggctctttcataaaaagtttttatgcatatgtgtctccatacaagtggctcattaaaataagaactttgtaaactgacttaaaatcagatattttttcaagagttagggaaagttgaagtgttttactgttttgtctcttgagccctttctctggggaaaaaatacatatccatctatctatctatatataaactgtgtatacattcttactgtttgaacaactattgcctttaattaaatgtttcatttttctccagagtccccaaagccacatggcattattatagtcatttttgagatgcctgtagagaatgaaagtattgactccgttagagggaaaatgggtttctctgggtgaattccaacgaagcatacctaggggtaacagtgaacctacctgggtttgttttgttttggtaaggatttatgtagtgtctggctgtaagcaagaatgagtggattataaacttgaagatttctctgttaaagtcacaaaaatgatcgacaaacaatatttttgtgatgtttatttaaacgttgtattttataacatacttcaaggaagagtatcgaagtaagttgctttataaattaagactaaattcgtatggatgcagaattcaattaataaaatttgagcctgttacgtaaattgaatattaataaaattgaaaatttctga

SEQ ID NO: 48232 - DNA, 227 bp, Homo sapiens
aaagtattccccttttatttttaaagtgaaaagcaaattgaaaaaaatagaattagatccgagctttattttcaacacatgtacataaataagccaggcacagaaagacaaatgtcatgcattctcacttatttgtgggatctaaaaatcaaaacaattgaattcatggacatagaaagtagaaggatggtttccggaggctgggaaggatagttaggggtgggggc

SEQ ID NO: 48233 - DNA, 1357 bp, Homo sapiens
tgtgaagaatctgatagtcgaactgaatgaagccaagtccagtctttacggaaaaatttacacaacacttccagcagtgacctgagaagctacgtattgacacggcgctaccacgggtggaggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggtttccaccttccaccaggaagtcatatggtaaaaagaaaaaaaatggcattatgatacaaacagaaaatgtaacagtggagtgcagaaaatacaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatga

SEQ ID NO: 48234 - DNA, 1030 bp, Homo sapiens
tcaatcctctccgtaactttacccaatatttaaaaaattatctaaaatatttagaaaaagaaaaaaaatggcattatgatacaaacagaaaatgtaacagtggagtgcagaaaatacaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatga

SEQ ID NO: 48235 - DNA, 187 bp, Homo sapiens
tgtgaagaatctgatagtcgaactgaatgaagccaagtccagtctttacggaaaaatttacacaacacttccaggtgggcagattcaaagacaggatgaatcatggttcagtgcagtggttcctggctgtaatcctagcactttgggaggccgaggcagggggactgcttaagaccaggaattcaag

SEQ ID NO: 48236 - DNA, 1983 bp, Homo sapiens
agtgtgtaaaagagaagagaggtccaaactgaaatctgaggagcctcaacattcagaactcaactgggcgctgtggctcaagcctgtaatcccagcactttgggaggacgaggcaggcagaacacctgaggtgagaagtttgagaccagcctggccaacatggccaaaccttgtctctactgaaaatataaaaattagccaggcatggtggcgagcgcctgtaatcccacctactctggaggctgaggcagaagaatctcttgaacctggaaggcggaggttgcagtgagccgagatcacaccactgccctccagcctgggcgacagaacaagactccgtgtcagaaaaaaaaaaagaaaagaaaagaaaaagaaaaagaaaagaactcggtggagcacaagtagctgagtaatgccccagaagccggcatcattgttggacagctcagatgttcaggatgtttcattttgagcctacctcattggaatttcaaaatattggcctctttggagcaatacagagcaagtctgttccttcaagtagatgaaaagctccctgcatgtcttccattggacttctcccctttagcttaaaaatatccacagtcctgaaacatggctcagaagcagatattacccaaaccctactcttaaagctcggccagccagccacatgcaggaccctgaagcaaataagaggcagtgacctgagaagctacgtattgacacggcgctaccacgggtggaggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggtttccaccttccaccaggaagtcatatggtaaaaagaaaaaaaatggcattatgatacaaacagaaaatgtaacagtggagtgcagaaaatacaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatga

SEQ ID NO: 48237 - DNA, 1380 bp, Homo sapiens
agtgtgtaaaagagaagagaggtccaaactgaaatctgaggagcctcaacattcagaactcaactgggcgctgtggctcaagcctgtaatcccagcactttgggaggacgaggcaggcagaacacctgaggtgagaagtttgagaccagcctggccaacatggccaaaccttgtctctactgaaaatataaaaattagccaggcatggtggcgagcgcctgtaatcccacctactctggaggctgaggcagaagaatctcttgaacctggaaggcggaggttgcagtgagccgagatcacaccactgccctccagcctgggcgacagaacaagactccgtgtcagaaaaaaaaaaagaaaagaaaagaaaaagaaaaagaaaagaactcggtggagcacaagtagctgagtaatgccccagaagccggcatcattgttggacagctcagatgttcaggatgtttcattttgagcctacctcattggaatttcaaaatattggcctctttggagcaatacagagcaagtctgttccttcaagtagatgaaaagctccctgcatgtcttccattggacttctcccctttagcttaaaaatatccacagtcctgaaacatggctcagaagcagatattacccaaaccctactcttaaagctcggccagccagccacatgcaggaccctgaagcaaataagaggcagtgacctgagaagctacgtattgacacggcgctaccacgggtggaggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggtttccaccttccaccaggaagtcatatggtcaaattatcccggatcctgaaatatatcttttgatagaaatgactctggtactttccgcaacttactttctatggagcactttcctgaaacaagatttgtgtttaaatattcctccttctacaaagtattaaacagtagtaagttctgcaacgttgacaatggaaacctggcaatgtgcccttgtttgactattaaggaattgcttccaagtaccacagggccttgaagaccaaaataacacaattacctggaaggtgaacaatggcaacttatcaggtgtggtaaacacttttttcccaagaagatcctttattccttctgaatgcacatcaagaaggagtgaatacataaatcacatatttgttaataaga

SEQ ID NO: 48238 - DNA, 419 bp, Homo sapiens
aagagtgtggtaaacagaagctcagctccttcaaggatgacagccttggttacaccaccagattcctcttcaggaccaaggactcattttccagctggcaggaatgttagctactgacggccatggctgagttcctcttcaggaattatcctccacttgaggggaattgctttgttcagtgttacactccctctatagtggcagcccacactggttgatgtggggtacaaagtcctggaccttgtcttagatgggatagttctgaagggctattccagctccagaactcctcataggattggctgaggtctcctctgcaactggatcacagttcaactttttcttctgcccagtccttcttctctcatctgttgccagttttattcgtgagtgtgtttcccaataaaccccctgcatgc

SEQ ID NO: 48239 - DNA, 769 bp, Homo sapiens
tgtggaagattagaagataatggatactattattccatccagattcctcttcaggaccaaggactcattttccagctggcaggaatgttagctactgacggccatggctgagttcctcttcaggaattatcctccacttgaggggaattgctttgttcagtgttacactccctctatagtggcagcccacactggttgatgtggggtacaaagtcctggaccttgtcttagatgggatagttctgaagggctattccagctccagaactcctcataggattggctgaggtctcctctgcaactggatcacagttcaactttttcttctgcccagtccttcttctctcatctgttgccagttttattcgtgtgagcattcggatcaccaacgctgtgacctcgctgtgtgaacgggagctactacaggaaggaagcttacaaatgagctgcatggatcccacattttgctaaaatcaaataggacctttctcctctttgttgaatgccgtaatacacaagaaataagccagcaggatgctcatgtccaaggtataccactttatcataccacacgagttggcatgaacacaacttctggggttcaaactcttctgaacacagataccagtcttggcaaactacccaagactactcctaaacgaggacattcaatagccttcaagtcgtaacttgcgatacaatcatctcctattggctcacaagcttcatgccagcggtatctccacagagcctgggccatattaactcc

SEQ ID NO: 48240 - DNA, 180 bp, Homo sapiens
caggtgtgcaccaccacgcctgggtaattttttgtggagacagtttcaccatgttgcgcaggctcgtctcaaattcctgggctcaagagctccgccagccttgacctcccaaactgggtgttttcttgccattgtgagccagctgctagattcccgcatgcacgttttagctatgtttct

SEQ ID NO: 48241 - DNA, 401 bp, Homo sapiens
caaggtgagccctagaatgattccagctgtctacctggaatcacttataggactgactcagaggaagaacgaagttcagcagtggtggtcctactgagctgagaagacagagctcagagttggggcggtagttggaatatgctgggaagggtgttggaatggagggaacagctctagggatatggggtctggtgagtactggctgaatgtaaagctgtgtcttcttagggaaatttcgtgagctatgcaaagaataactactggagtttttctgtgtaggagatgttcaactcctactagttggagtggaacgaccaagttgaatactggcataattagtgtggaacccagaagggccacactctagggctaaatcagccctcaaaggcctttctagacca

SEQ ID NO: 48242 - DNA, 375 bp, Homo sapiens
tggttgccatctctcagtggcccatcattcttacatatttcatcgccattgttattcttttcaggtcattacatcttcattgtaaaatttatcctctcacctgggtttcttctttgtgccaccttagtttcttagataaatcatcatattttcctagattcccatgaagatctgtgaaaggaaaagaggtggtgatttgggacagaataggattcacagcctataggaactctagagggacaaagttcttgcatattatctaatcagaatgatttagtgccaacttgtagatctcaaaacttggaaaaaagtaaaaattgtcaaaatatatcaagaatggatgagaagggattaaaaccaggtgataaggatggg

SEQ ID NO: 48243 - DNA, 195 bp, Homo sapiens
gtggaaggtattgaggatgagctgagaccatctgcatagagggcttaacatagtgactggtacttagcaaatgctccatgagttatgattgctggcactggcatgctctccagagtggccctcaggacaggggccctcagccaccaaatcctagacagggcttcctctgacagaggtgcaggctatgactacatg

SEQ ID NO: 48244 - DNA, 355 bp, Homo sapiens
tcctgttttaaaagcaaaacgaatgctaaagaatttttaaaagtcaagttttaaaaactcttttcccatttctctctaccctctaagcggacgtgtacccaaacagtctcaatttatgtttcaatttctacagaagattggttattcctcataattctccatcagatgatttctagaggcaatctcctctactttggcactgtaatgaataaaacttcattgtcatgataaaagcctcgctctcttttaaagaaaaaacagatcctaggatcctagatttttgaaaatggaaaaaattcttctacaggtaggtctcccttttctaattaccaacaaagtcatatttaagataaat

SEQ ID NO: 48245 - DNA, 373 bp, Homo sapiens
gatcaaggaaacaacatcacataaaaatgaacaacagaaagagattaatagaaaatcccatacagattctatataaaaaattgaggaaaatagaccaaaaacccacaagaaagatgggcaaacacatgaacagattatcccccaccagtgtacaaatgaatacataagaaaaaatgttcatctttatccataacataaaataaaagactgagatattggttttcacacatcagattggcaaaaattcaaaagcttgaccacaagttgcattactgtggctatggggacaaagctgctccctttcatccttgggggagagcaacatggtactattccatgaaggggaacttgacaccatataaccaccatatgc

SEQ ID NO: 48246 - DNA, 889 bp, Homo sapiens
gagccttggatagggaaaggaaggggtagacaggcttagaggcagagactattcttacctggcttacagttgtattcccagcacctaagccagtgactggcacgtagtaggcactcagtctttctttagttaaatacaatgaataatttaatgttgggggggatatggtaaaagaagaagaggagagttggaaaactcatgggcatcttcaacagacaggagccccatgactggggggtgtcttagcaaaaggcttcctggcgtcataacagaagtagtcacagaacccccaagaccggaacctgttacaccagagggttggtgcacattcacgatgccctctgtcgaagggccccaccttccatgcctgcgcgtctccttttgttctgtcaggtttagcattgaggcaattggtggccgccgcctcctttgcctcatctgccccaaatccctgcttgccatcagcccaatgcagcaggctctggtgccaaccacaatctccccgggaaagagatttgagggactggaattgtgagagaaatgtaagctctgagcttgacggtggtccatgagcccctccccttctcacctttgaagcaagaaggggctggttccagggctctgtgggaaagctgctttgaagaatggtgaacttgggccacggggcatcattctgctttagttgagggggtccctgttgggttccaaagagaatgcggtggggttaacataaaagcagagtttagcagtgaggaacccattggtctatggcctgctttcttaattgttagtgaattaagccaggaaggcactgggggtggctggggagatcctttgtaagaggttaaggtcttcatagagtgatgataggattagcaataatttggtg

SEQ ID NO: 48247 - DNA, 831 bp, Homo sapiens
ccaggggattatggaatgtttggtaaaatccctggcctctgtccaatagattagctagtagctctctcacccctagatatgaaaaccagaaatgtctctagacattgccagtgtcccttgggggtgcaaaattgatgccagttgagaactcttgaagtaaccatagcacctctgcactggaccggaaaagcgaatgtcttcaaggaaggccaggtttttttttttagagtatgagtcactctaagaatcaaatgaatgattgtctatgccatagagggtgtctaagataactttggcctatttaattttcaaaacaaatgtaatcaatagtctaccttaactgtagttgtagaaaaaacatttacacccatggaatgtgctgttttaagaagactagttttctggataaaactagcaggataatttagttttaaaacatattcttcaccaaaaattgacctgctttacagagttacagatgatgtactaaatttcagagaacatccaccaaaaataatgatttttactttacattaagtgtttctggctgtgcgtgatggctcatgtctgtaatctccacactttgggacaccaaggccggaggattgcttgagcccaggaattcaagaacagcctgggaaacatggcaagacctcaactcttctaaatatgaaaaaaatatcagggcatggtggtgtgcatctgtggttccacctgctcgggaggctgagatggaaggatcgcttgaacccaggagttccaaactgcagtgagctgtgattgtgccagtgcactccagcctgggcatctctaaatctcttaaaaaaaaaa

SEQ ID NO: 48248 - DNA, 287 bp, Homo sapiens
ggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctagaggctgagtgag

SEQ ID NO: 48249 - DNA, 441 bp, Homo sapiens
  misc_feature (357)..(357): n is a, c, g, or t
agctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtncgcctgctgctgcccggggagctggctaagcacgccgtgtcagagggcaccaaggccgtcaccaagtacaccagctctaagtaa

SEQ ID NO: 48250 - DNA, 928 bp, Homo sapiens
cttcatactcccatgggggacgtgctcttgatactgtcaagagttataactctagcaaggggcaatggttgcaatctgggcaggacaaccatgagaggcagtgcagtgatgcatctccctgggtggcaggcattctctctcaattatccttcctcattgactttggtaatgaaccttcataaagagaagataaattctcctgggatctttgggtccctgagaagcaggagagctgacattggaatagagaaaagctggcatcttaggctaaatgatgactgaaaagggtgtaggcaattttcaggtttcttcctagattgtccaactcaatcagggcaaaggagggagcaggaagtccagaaaatcatcatgttcatgaagaaagagtatgcatttgtagagagttattcatgagtttgagctctcagaggagccggtggagcggaaggcattggatgggctatcgtagcaggaaaaggggcatttcaagatcctaaggtctaggattcaggaaattcaatcaatcaacacctcattatttgtttctatctcaccttcttccataaagaatgatgatgtgtccctgtgtggtcatgtaaaatgggttacaatttggagacagaggctgagggtggaaaggctgaagaagccatgaagaaattgtgtctgggacctgcgggaggggcagacagaagacgcaattgtgcgcaaagactgcgtattctcagtagccagtgatttaagtttggtgtgaaggatatagcatctttgggaagcaatttggtgattctcaggaggaacagggctttttgaccaaatcagtgttacacagaagcagcatgtggttgtgataccagttcagaaaactatacatacataacctgaaaagcgaaagttccttttcatgacagcatcccccctcaaacct

SEQ ID NO: 48251 - DNA, 1071 bp, Homo sapiens
tggagagcctgctgttagtcaccaaactgattgccgcagctattgcactggggactcggggcagctggcaaaacatcctgcttggaagcaaatcctgaagaggaagtccatagaggtttctgcaacataaggcccatgaaaccgggccaaaggaaacaatcttaaaagaacagtgacttgatttactgtctggcttaacagcaagtcttggagcccctgctagttgactggaattaaacagcagatttccatttaggaagacagtcagttcctagaatgcctgtccattctttgcactgtatgtagttccagtgcgtagtgaagtgtctgacatgtaataggaactcagttcatgtgttatgttctttgttctcccatttttaatgaggtgagcaggaaatatgtattctagttaatgagatttcagttaattcaggtttcactgcacgtggcttgacacagttgcttacaggtttccccaagtaaatcattgttagtggccattcctaaaatgaattctggcaaaactataattaaagctacactttacaagtgagaggcaattggtaaacagctggaacagccaaccccaaccccaagtaggttggctcttcctggcaggcttctccctggcaagaccacgaaagcaatttcagacccaacgagtcaggggaggctttggctccccaggatctgaaagcagcaaaggcaacccgccccctcctcaaagccctcattcaaggggtggatcacgaaggccacctagaatgcaggcagagtgaggcttactgtgcctccacattttgaaattgcttgaggcactacttatagctctctgcatttgtaaaagcgattcctttgtgaccccctacatcgttgcagatactctacctcaatcattattggtccttaggagtgcacagtatatggatagtatacacacatcaaaatacgtcagccttcccatgaaacctagaacataggccattgcagtgttttttagattactcttcccctaggaagtagacaaagaataaaaataagatatgagcatttgtatagcttttatta

SEQ ID NO: 48252 - DNA, 279 bp, Homo sapiens
atcaatggaatacagtagacacttgagcaagaaactctagttttatacagatttgatacagtgggtcctctgtacctgtataaatctctaggttccacatccatggatccagtcaaccttggctcaaaaatatttggaaaaaaataataaagaataacaaaataaataaaaaacaatgcagtataacaactatttacatagcatttacattgtactagttattataagtaatctacagatgatttaaagtatacaagaagatgtgtgtagttgtatgca

SEQ ID NO: 48253 - DNA, 597 bp, Homo sapiens
ccctgacctaagggaatcaagtggttgtctgccagtgacctcaagccagcagggcatgtcaaacttaggaaagcagtgtactgagtgacttgagcctgcagtctcagctacttgggaagctaagacaggaggatcacttgagcccaggagttcaaggccagcctgggcaacatagcaagatcttgtctctaaaaacaaacaacaacaacaacaaaaccccaacaacttatgaaagcactcaggatcctcctattggagtcagagctatgacctaattatatataagcatggtttctacatgaatggttggaccttgcgtatctgtttccatctctaagtgacccatgatccttccagtcaggaactgaaaatacctgcttcagattaaatgctgcctcctccaggaaggcttccaggattgctgcaacactccgtcccttccctgaaaccccaatgtttatggctgttgccagacttttggcaatactgttatgacaacatgacctctaaatactaacctcttagtaacacttcatggttcaccaaacagtttcactagccaggataatatcactcaggctgcaggtgcagccccag

SEQ ID NO: 48254 - DNA, 713 bp, Homo sapiens
agatgtcattgtattctaagtttcagtttcttctataaaatagattaaatactattgcaaaggactattgtcagggtctgttcttattgcttccatcctactcatacctcagtttgtactccacatagcaaccagagtaatcatgacttagagggagaataaagtcacaccgttatatttctgtgcctacaacactccagtggctttccatctcatttaggagaaaagattcttagcctgaaaccagcctcgtagcatctagtcacctcccatcgttgccgggccacttctctgacttacttgggttccagcgacactggcattcatacttttttaaaaaacatgtcaaacaagttttaggactttcatgtttgttttttcctctacttggaatggcttgctccttcattttctttaggtgtcctctcaaacattgcccttctttgaaatcttgcttatgataagataggaagctccctgctctttcttcctttatttttctttatcacagttgttgtcatctgacatactatttcttgttcatttactggctctcttatactagagtccaggttccataaaggcaggatctgttttacttacagctctatttcctgcatctggaacaatgcctagaacatagtatgtactaaacttacatatgttggataaattattttctaacagaatataaactgccaaagttgaacaaa

SEQ ID NO: 48255 - DNA, 568 bp, Homo sapiens
acttcaagtaactgccaaatgtcctttcactgcagtatgcagggttctctgacttgcactgtatttctttattttaatttaattttattttagagatgatctcactctgttgcccaggtttgaatgaagtggtgtagtcagagctcactgcagttttgaactcctgagctcaagtgattctcccacctcagcctcccgagtagctgagactacagatacatgccactacacctagctaattttattttttagagagatgggctcctgctgtgttttccaggatagtcttgaactcctgggcccaagcagtcctcctgcctcattcccctaaagtgctgggattataggcaatgagccaccacacccagctacttgtagtgcatttcctgtaggacaggtctattagtagctaactccttcagccattatttcttcatatattctctcttactttcttattttctccttctggggttccattatatatattttggtatgctttatggtgtcacacgagtctcataggctctgttcattccttgtcatccttttttctttctgcttctca

SEQ ID NO: 48256 - DNA, 306 bp, Homo sapiens
ctcgcacgcaccatgaatgagaaggctttgggaaataaacacactaggaagtcgtgtgcagttggagttccgctcactaacacatgttcaaaacaaaaagcccaatttggatgaaaatagcaggaagccgtcccccagggacacctggtgaggtcatattgcttggctctgctgcttccatttttaccaactctgctgccttctgccaattcaaggaggccaggaaccacatccagccccatgcggctcaatgggaaacgagagctgctctcggaaaagcagatgctagaaccacagccccgggct

SEQ ID NO: 48257 - DNA, 275 bp, Homo sapiens
atatgataatggtaaaatcttcttatttttaaaatattttacctgttagaaatacatagtaaagtactatggtgaaataatatgatggctgagatttacctgagatgtttcaggaaaaaattggaggtagtggagaaaggataaatattaataaaacaaaatgggaaaactgttgctatttgttgaagcttgttgatgggtacatgggattcattatgctcttctctgcatttgtttattggtttgatgatttctataataaaaagtgaaaaaag

SEQ ID NO: 48258 - DNA, 649 bp, Homo sapiens
acaaaacacatgggatgtagatgtggattgggagagcccctgaattgtagcactctgctttcctcatctgtaaaatgggtataatcaaagtcttggaagggtaattgtaaaggggtgtgcagacagtggggttactgttatttgcaaggatccgcccatagttttatctgcaaatgtcactagcttttgatttactcactctcgcttgcgtcttctttcgtgctgatgttggctctgctttatcccacaggctttttattattattattacttttgagacaaggtcgctgtctgtcacccaggctggagtgcagtggtgcaatcttggctcactgcaacctctgcctcccaggttcaagtgattctccccactcagtagctgggattacaggcacgtgccaccacacccagctaatttttgtatttttttggtagagatggggtttcaccatgttggccaggctgagtgatcctcccgccttggcttcccaaagtgctgggattacaggcatgagcccctgcacccagcctttctttctttctttttttttttttttgagacagggtctcactgtgttgtgcagtggctcgatcttggctcactgcaacctccgcctcctgggttcaagcagatctcatgtctcagcct

SEQ ID NO: 48259 - DNA, 727 bp, Homo sapiens
actcctgggctcaaaggatcctctggcttcggccctccaagtagataggactgcaggcacgcaccaccatgtttggctaagtttttatattttgtagagacaggttctcactttattgccaggctggtctcgaactcctggattcaagaaatcctctcacctcagcctcctaaagtgcagggattacaggcatgagccactgcacccggctaattctcctactctaaaaaccagtcatccttgtctttcctcctcacatcaagtggccaggcctttcacaatgcctgtctttatttagtgctatctctcctgccactactctagctcagaccctgattattctctcctagaaaactaaattaacctaacccaattttttccaaagtgtggtgtattcactgctatagttactttaatgtgattaggaaaaaacactaacacatcaaaactttgatttcaaaatagaattgtgtcaagtaagaacaaaataaatctggaaatgagtagatctgaagaaaacaatgtaggcagcaatgaatatggaaaaagccatcaaaaatggtaacataaatggctgaaatgtgagaaacaccatgttagtgaatcactttgctaatctgcaaattagttaccaaattaattcttcttatatgttattcagatcacaacatatcctattcaaaatctccagtggcatccccattaactccaagtaaaattataactc

SEQ ID NO: 48260 - DNA, 553 bp, Homo sapiens
aagtagaattttttgatagtgatagtttttacaattgttgggtacaggcttctgtatatctccatgtaattaactgagttaatcatattcagatcttacatatctttactgcttatacagtgaattactagagaagcatgttaaaatttactatgatttggatttgtgtatttttacttgtggttctcatttttttctttttttaagagacagggtctcattatattgcctaggctacactcaagctcctaggctcaagcgatcttcctgcctcagtctcccaactagctgggactacaggtatatgccaccatgcctggctaggttctgttaattttgctttatacattttgggactatttccttaggttatatactgatacatacttgtcatatcttcttagtgaattaaaccatttatttatttagaagtaacttctttatagatataatacttttgccttaaatattctttatctgatattaatctagccccacttgctttcttttggctaatatttatatgattttcataaaggatttattaacaaaa

SEQ ID NO: 48261 - DNA, 767 bp, Homo sapiens
aaaatattaaataaaaattaaaatattaaattaaaaataaaaattaactgagcctggtggtgcacacctgtggtttcagctactcaggaggctgaggttggaggatcacttgagcccaggagttcaaggttgcagtgagccatgattgtgccactgcactccagcctgggtgacagagtgagctgtctctaaaagaaagaaaggaatcagaggtgattcctgttcctaaggggctcacagtctggctccaactcttttttcctcaccctatcctatataagtttccactgcccttctccatttcctcggtcccaattcaccttcccatttcctgcctctcttctcctgagccccacctgtaagggatgacctttttactgattaaaaaaacacaagatgtgctcagatttgaggagagaaggacatttgtaagaaaatcttttggtagaaaggcactgaagatcagcaactcttgtcggatggaggactttatgtgtgtttatttcagcaaacatgtaaggaaactgcctctttccttagtcaacaagaccagattcttgagctggtaatggaaagagcatctccaagtagggagaggtggttgcatctggaagccccaactctcatcctgaccccctgggcattctcttattcatgaactctgccacacggatctggtggggtgtgtatctgtgccatcttcctgttaatgatctagacaggcatgatggacccttcctgagtggctattaaatggggatgttttg

SEQ ID NO: 48262 - DNA, 369 bp, Homo sapiens
gcattgaaacaattgcacatagaaggtgagacttccaatttgaacctaagtaggttgattgcctactaaattcatattaatttactaagactcagagttttcacaactaattcacaatgcccaggatacactctaaaattactcagcctacaaagaaccaggaaaaactggatccacctctctcaggaaaagaaccaatagatggcaaccacgagatgacccacttgttggaattatcaaagactatcccatgttctgcaagataatggtgaacactggtgaatggaaagacagaggttctcagcagacacacacaggaacttcaaaagagaacaaagggaaatttttagaattaaaagggcaatatct

SEQ ID NO: 48263 - DNA, 943 bp, Homo sapiens
caaatgtgtagcggctaaaagaatttgaaaactccaaccgtaagagacttttttccatgacttaatgaggctttcttaagtacacattcagatgctacggaaattcccacttccagattagggaatttttgtatcttcaatttttttttttttcttattgtctgctttagtagagttttccctctagcttcatttgggaaaatttcatcttcactgtactttccttcccaagatgcaattatgttgacaatttagtgatttatttgaaaggtgttctgaccagttatgggtcacatttgaaaagcatctgtgttaacagcttgacatatgaaaatacagcaaaacagacaagctttgatgctgtcttggccagccttatctccagttttatggccctggctaggagacctgatatatttagccattgaactgccatgtcaagtcagtgacattttggaattttcctactcattggatattcacgttgcttaaccacgttcagccccctccaaccccccaatccctgcccaaaatagaaaaataaaactaccttaagaaagagcgcctgaagtaagtctgaaaagaaagcataattgttcatttttgtctctcataatcaaataagcaggcttgggaatttacaaagaagagctatgtaaaatctgcaaagcattattaaagcctgaaagaagaggtaataagagaaacgagagacagataggaattgttagcttcatttatcttaatacttccacctgagtattttttcacttgtaaagaaatgtaagaatgtgtgtgtctttaaaaagtactttttctgtaatcccagcactttaggaggctgaggtaggaagattgcttgaggtcaggagttcgagaccagactgggcaacatagtgagacctcatctcgaaagaagaagaagaaaaataaataaaaagga

SEQ ID NO: 48264 - DNA, 647 bp, Homo sapiens
gttgtgtaataaagggagtcagggtaggagatgcaactgagacaagctccaaaggataaacaggaggtggggtgggagagggaagtcaaggcaaaggtcttcgctaaaagacctaggggaagaggagctaagaaacctagggacagtgggagatgatgcagaagaaagaggagttagaccactcagggccttggaaaacatgaagatttggctcttttcttagaacagaagcctttgaagaattttagacaggagtatcatggcttaggctggcttttcaaaaaaaatcagcttgtatggagagggcccaccttggacctggaagttaattagaaggctactggctacttcagtagtacaagtgagccatgatggtgacatagacttgggtagtagagttggagaaaagtagacatttgaaaattacaggtcaaaataaaagtatcagatttctccaggtagttctggcttatgtaactgccatttaaaaagaagtcttaagatagaagtttatggctgggcgcggtggctcacgcctgtaatcccagcactttgggaggccaaggtgggtggatcacgaggtcaggagatcaagaccatcctggctaacatggtgaaaccccatctctactaaaaatagaaaaaaa

SEQ ID NO: 48265 - DNA, 906 bp, Homo sapiens
gtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatg

SEQ ID NO: 48266 - DNA, 260 bp, Homo sapiens
caattctcccgcctcagcctcccaagtacctgggattacaggcgtgcaccaccatgcccggctaattttttttgtatttttagtagagatggggtttcgccatattgcccaggctggtctcgaactcctgacctcatgtgatctgcccgccttggcctcccaaagtgctgggattgcaggtgttagccaccgtgtctggcccagtggggtctttctaagtcatcaataagtgtccaggtccctcctctactccccgctcc

SEQ ID NO: 48267 - DNA, 820 bp, Homo sapiens
ctaggtcagcctttctctattgttgaacagccaatgaatggaacctcattctgggcctgtctatgtgatcaaaacacctggaacagttagactctgggcaaatcatctaaactctgtgggtttctgtagcccctaaaggagaaatatgcagagattgcagcagggagatgctaaagccctggtcagctcccagatcctgctactgaggtattttctccagattccttttcctgcagcatgtccttccgggggctgcagagtctgcttgctgacaggcgtctttgaaggagaaaggaaaggctgcttgaatacagaacaggcagggagggcatctcaggtccatgaaaatggaacgaacagaacttgctgagattctctgtgccagagagcagggccactgcttacttaagcaaagtatcctgagaaggagggggaagaaataattaaaagagtaacagtggcaaagactgtagtgacttaaatgtcaggagggcctaatttgccccttaggagattgagccttgagaagcccctgacttctgctgatgtctaggaccactgccctctgcaggccagaagtggaaaggcaggctgctacctagccggctagggctgcacctcagtccgtttgtgagtacagggtctgtgttctcttcttaaaatggacaacttccttcaaaattagcggggtgtggtggcacgtgcctgtaatcccagctacccaggagactgaggcaggagaatcgcttgaacccaggaggtagaggttgccaagatactgccattgcactccagcctgggtgacagagtgagactctgt

SEQ ID NO: 48268 - DNA, 363 bp, Homo sapiens
atgttggtcaggctggtcttgaactcctgacctcgtgatccaccagcctcagcctcccaaagtgctgggattacaggcgtgagccaccgtgcccagccgtataatgatatttttaaaaatatttcttgaaggaaaactcttgagtctggaattatttttatagtttgggatattttagctaattcatctggggtgtgtagtgaactcacatctagggctgggaaatctttctggtttagtaatttttcattgtaattgatgcactcaggaacatacctccttcctaatttcagagctattttgaaatatgaatgaaaaactcagtaaaaaaaaaagtcaacttttaaaaatagtagggtctgg

SEQ ID NO: 48269 - DNA, 310 bp, Homo sapiens
atgttggtcaggctggtcttgaactcctgacctcgtgatccaccagcctcagcctcccaaagtgctgggattacaggcgtgagccaccgtgcccagccgtataatgatatttttaaaaatatttcttgaaggaaaactcttgagtctggaattatttttataggctgggaaatctttctggtttagtaatttttcattgtaattgatgcactcaggaacatacctccttcctaatttcagagctattttgaaatatgaatgaaaaactcagtaaaaaaaaaagtcaacttttaaaaatagtagggtctgg

SEQ ID NO: 48270 - DNA, 335 bp, Homo sapiens
tattggcctaaaatgctgatctctttcctttgaccctgaaaactccaaggaactccagttagggcttcctcaacctagtaagatttgtaagttggtagaatcttacttatcacccctgactttcttccttcttcctccttagtgaaatagacagcaagttagagcaaatggagcaatatttagtgctaaagctttagagccaggggagggtaatcaccaacacgggccaagccgtaatgacttggtacacccagagaaggctgggctgcagccaggcagataacctaagggactgctgctgttctctcccggcacacacacgtgctcatcactca

SEQ ID NO: 48271 - DNA, 322 bp, Homo sapiens
tagaccacttgaagctgtttttgagaatacagattccaatacaaccacaaaaaccttaccacatctaagaaaattaatactgattctatcttatgtaatatctgttctttatttaagtttcccgaaatatccccaaaatatcttttatagctttcatttttttccaaaccaggcaaggtttatacattcattgcatgcggttatgtctctttcatctctttcaatctagaatagcccaccccatcatcttttcttctgttggacagttatactaatatgcagagatgatgtcatatttttcactacagaaaaagcactcata

SEQ ID NO: 48272 - DNA, 466 bp, Homo sapiens
gatatgtttcttttctgtgcagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaa

SEQ ID NO: 48273 - DNA, 238 bp, Homo sapiens
ctcttctcctgtatcttctgactcaaacactgtcacacactcagtcatcccagctagcgtctgtggagtcgtccttctggtgtctttccttcccggtctcccttccctcacatctgagaagtgcaaaaatcccatgggtgtcactccctctgtgcctctgcagctagccccctctccagcccctcccactctcctcaccttctcccacctggacaatctcagctgcatccttaatgga

SEQ ID NO: 48274 - DNA, 395 bp, Homo sapiens
gcaccaccacgcccggctaatttttgtatttttagcagatggttttaccatgctggccaggctggtcttgacctcctgacctcaggtgatcttcccacctcagcctctcaaagtgctgggattataggcatgagccactgcgcccaaccctggttgcagttttttcatgagatctgctggcatttccttgctcttggtttcccaagacaatgccatatcctccccatttgggttttaggggagcctagtgggtttctgttacttgcaaacgatgtggtcttcactaatatggtaattaagtaaagcataaagtaaagctaggcagtgaccatggctcacatctgcaatcccagcactttgggaggccgaggcaggaggatcgcttgaagtcagga

SEQ ID NO: 48275 - DNA, 320 bp, Homo sapiens
ggaccttgtttggttctcaatatgaaaaagctacctccaaaagtatgttttgaaacaattaggggaaaatgggtatttttggactgggtattaaaaaaaattcatcttatattatttgggcagctattctacttaaggaagaaaaggcgtaataataccactacacatttattttcaagcacaaattaaacttacacaaaaagcttatagaatcagacccattttatagatgggaagaactgagggatatggacaactatcagtcaacatttaccgagcacctactatgtcccgggcagtgtgtggagtacttgagccca

SEQ ID NO: 48276 - DNA, 518 bp, Homo sapiens
taaataaatagcaggcatggtggtatgcccctctagtcccattgctcaggagtttgagaccagcctgggcaatatagtaagaccctgtctctaaataaataaataattatcaggcatggtggcatgcccctgtagtcccattaggaggctgaggtgggagaatctcttgaacccaggagttgagtctacagtgagttacagtcacgctactgcactctagcctcagtgacagagcaagactctgtctctaaaacaaaacaaaacaaaacaaaacaaaaaacaaacattgaagctgggcatggtagtgcaagcctgtaatcctagctactttgagagacagaggtaggaggatcacttgagcccagaagtttgataccagcctgggcaatatagtgagaagccatctctttttaatatttttctttttttcttcagaacaatatgaatataaccccatctcttaaaaaaaaattacatgagacatgcttaacatagaaaaactagaaaaggaagataac

SEQ ID NO: 48277 - DNA, 658 bp, Homo sapiens
gcttatgtgcataaaataaatagatggaaatacagtattatcttctttggattttgctctcaaatctgtactaatattggttatcaagtatgcacagccagcctgcttctgttgcactgcatgatggcatgtaatgatggaacagagctgacatgttcacaaaagcacttttctctgtgggtaggagtggaaaatagttccatttagctgatatcactaatttttaaagaaaaccatatgagctaaagagaactgaagatgaatgtgggagctatgagtcaaccactgaatctcagctgcattaattttacattataaatgacacagttttaaagtttcttagattttataatagttgaaatttttctttaaaagagtacaccctatacatgccgatacacgttaaaaagattgaacatttcttcccattctaaagcatcttgaaaacaatgactgtgctgttagcgatttttaatataaaatacatttcctagcagtgttataaaccgctaacagcactttttgtgaaaattggctacttcatacaaaaaaaacctcacagtttttgttatctttgtaggattttcttccccctttttgaattgttttataatggataatgttgcttaaaaacatccagcatttccatgagaaatga

SEQ ID NO: 48278 - DNA, 288 bp, Homo sapiens
agatacaggttgatgcctttacatctgagtttttgcaaaagcataagtctcatgctgtttcaagtgaacatgggcgccaatgtcatttttttttgttattatacttgcatttttgtaatcctagactaacctacttttttaggcaggaaaattctctaattagcattaaacattaaatactgtttattgctcccaattccattttgacaactgaggataataaaacatacttgtccagtactgtgagacacagtactttatatattgtagctcatgttattctcatga

SEQ ID NO: 48279 - DNA, 1847 bp, Homo sapiens
  misc_feature (84)..(84): n is a, c, g, or t
  misc_feature (542)..(542): n is a, c, g, or t
  misc_feature (858)..(858): n is a, c, g, or t
  misc_feature (1339)..(1339): n is a, c, g, or t
  misc_feature (1615)..(1615): n is a, c, g, or t
gatgcatatttgtttccatgatcatttgaaattctatggagtcaccactgctgattcaaacctggccaggcttcctgattctantctcatcccagggtgaattgaggttagctgctggagggaatgttcagttcagttgaatgtaaatctagcgccaagccacatgtgagctgagtgtgccaggatgccaagtgataaatcgaggaaagaaagatcacatgaggctgacatcttagcactgacacatggccctcttctgcagaaatactgggcaaagagttgtgagtcagctacaaggaagatagggctttccactgaaaaaggcagtgttcaaaggactcattcgtcaggaaaaagaattcccatgtcaatgagagctgaatgtgagctacactcatctttggataggtatttgatgaatactcgtattcttggagtgactttccaacatttaactaagaccattcagccttcacaacccatttgacttaaagggcaaaagtgcctatctgacaattttgatgatcagacattgccttctnccccttctactcctgctagatccattctagtctctgtctagttaattcctttaaaaacctccatgttaaagtagacttcaatatctagcatactagttccagaaaaatgataccaaaaaggtatattagattgcacatggtggtgaaaatgtttaaaaatcctgaaaaaaaaaaaggtattatgtaaaagagacaaaagagaggaaaaaagctctttggattttttgattagcagaaggtacacatctttatgtgcaaaaaacctgccgtctcctaaatatccttatttggggtggtgtaggtcataaggggtagnatttatatttagaaagtacatatacattttaaacttaataatgttgaaagatatgcactatacactcataaaatagccttataatttaaaaaaatctatatgcacttattacaagtattttaaataaaccagaaaagtctaaataaaaagtagcccaaattctgtcacccagggaaactctattttattaatatctttccagacagctctgtatggccacacatgcaattttataatgggattataaaattggggttatacccctcatactgttgtccaacctggagaattatatacagatgctcctcaatttatgatgccactgcattcccaataatccattctaagttgaaatcttcaacttacaatgggtttatctgggtgtaagcccattgtaaattgaggagtgtattgaatatatatcactttcacatcatcataaagtcaaaaaactgtaaatcaaaccttcctaagtcagtgnccccctgtacccttaaacaatgagataaacttccatcaagcatggcagtactctggctttgttctccgtttgaaaaaccgtcactttataggcttaatatatctattttacacattaagactgtaccttcaaactgtgttgttccatacagtagccctagtcatgtgtggctaaacttgaattaacaaaaattgaataaaatttaaaattcagttcctgaggtgcactaataacatttcaatggctccagagtaacatatggctggtggctactgnattagacaatacagaatggtttcatcatcacagaaagttctgctggacagtgctgagttggaaccaggtgttctttacacacagaccacttaaagactgaggttttatttatacacctgagttttccaagcacttttatctttgactgtggccaacattctatagggctaaatcccaactttagcagccggaagtcgcaactgaagagaccagccatttggattaggaagac

SEQ ID NO: 48280 - DNA, 410 bp, Homo sapiens
aaaagcagtgttttaaagcaaacttctaaatggtcatagttaactttagggtaatactctaagttttctgagatggaaagcacagcatggtgactacagttaataataatgtactatatacttgatgaatatgttaattcatcaagttaattactacaaattggttgtaataatcctttcacagtgtatacttatatcaaaacatcacattgtgcaccttggatatatgtacttgttatttgtcaattatacctcagtgaaccagaaaaacagttttctgtggcaagcacttttctccagtggacagagagttcggttgaaactagcttgctttatatgcaaaagcaaccccaacccctttttcttttataggacatgtgatacatgaatttatttttcttgtgaacact

SEQ ID NO: 48281 - DNA, 746 bp, Homo sapiens
gagagcttccagatagccgaacatatgggtgctcctggaaggtagagtgcccaggaaggacatggagactctctactccttcccccataccttgccctacacatctcttcattgtatcctttgcaatatcctttataatatactggggtaaatgtaagtaagtgtttccccaagttctgcaagccactccagcaaattaattgaactcaaggagaagctggttggtcagaagttctggaagagtagattattgactggtgtttgaaggtggggtggggtgcagttttggggactgagtcctcgatctgtgggatctgatgctacttccaggtagatagtatcaaatttgaattagaggacacccagttggtgtccactgcttgctggtggggaaaaccccacaaacgtttggtcacagatgtcttcatgttgattgttatggtgtgagagcagaggaaaacatggttttaatgtttttcccaaataactggtgtcagagaagtgagatttgctaaaaaggccctggctcactgaaacatgtggtttgggaagaaaaaggataaaagggtagaagatgagaaacctttgttctggtgtggccacatggtcacccaaggtatgaagccacagctgctatgctcggttattaaaggtaaaagttatcagtggaatttagagatggttccaactcctggggaattggttcactggctgcataaggaaatgcaaactaataagaaaaaaaa

SEQ ID NO: 48282 - DNA, 551 bp, Homo sapiens
actggcaaatgcttagcatagaattgcctagttgacgtatggatcttttctaggttgtaggatttggtagtgtagatccccagagtcacactgtatctgttgcctatatttggctaggttgagtcatgtcaccaaatatagcctatgccttcggcatgatgtatgccaggcttctggttccaaattctgcagctggcctccagagactactgcttttcctgtcataatgttccttaagattagggctgctgaccaggcagtattttttatatttataacaaaatcaataccaagagccttcaaagattgaattttgctcatcaaataggttcacatgctgaaatcctaatgccttccttctccctttagaaattaaattctgaatgtgcccaaacctggataatgattaaagatagatgagttcttggctgggcaccgtggctcatgcctgtaatcccagcactgtgggaggctgaggtggaggcatcacctgaggtcaggagttcgagatcagcctggccaacatggtgaaactctgtctctacaaaaat

SEQ ID NO: 48283 - DNA, 1368 bp, Homo sapiens
agacagttcagtggcaaagggcagaagtggtggatgcatctgtggtagattgattaaaagcaacgataggagcgatgagcagcaggctctgacagcaaagtggaagagatttgtctgggttgaattagaggaaagtggtgaggaggaaaagcagaggtgatttagtgatagtgatgaggatgctggcagaactggacatcatcacacattcctgaaactggtatgaggcaagaaacagtcctctctatacaagagcctaaactcttaaagaaatgatatgtacctttttagcccttaaggatgccattatgccatgctcttggtacaccctacatagatgttaagaccaggaggcacttgttcattgtatatagtggtgcaagctaagttagttgatccaatatctcctacccagagtctcagctgtgcttatatcccaaactactgattatgttgatgacacttaattcccaaggaaatactgcatttagtatatgttcctcaaggtggccaaaaaagaatatagtattttttagaaatttaaataccagtgtaaaaaaatcctttaatattcctagtctggagaaaacttcttcagattgattttactgtaatgactggcattaactgctcataaccaagctaacttccagtaggaatattgtcagctttgctttactgatagctgagactctagtcctgtagaagcagtactcatacagtagacaggttcccctgatcttgcacatccaatcttatagattttgccgtggacacaggaagctactgcttatctgtgtgttccaatgcctatcactgtctgtcatgtgtaaggaggcgatgatctccttacagataacgtgaaaacaaaagccacattgggctagacaacaacattcacacattctgaattagagcaggctgatttaataaaatgttactgtaatggtgacattttaatttacagagcccttttcaagtattcttgaattatttccataacaaccctatgaggcaggttagggttggttttgttatttccatgtaatataccaagaccagatggagatgcagtgactggtataagggttacacagatagtaagtagcagaagaaattgaatctaggttttctgactctaggctccatgttctttctaatttactgccaaagctgctaaataagggtgattttaaggccatttggaatacttgcacatgagcttacaagttggagaatttctcaaatgttgcttcaaagtgaaaggttggccaggtgtggtggctcatgcctgtaatcccagtactttgggaagctgaggtgggaggattgcttgagcccaggagttccagatcagccagggcaaaa

SEQ ID NO: 48284 - DNA, 402 bp, Homo sapiens
taatttgtcaaaatcaccttaagtaaatatttactttccgtatttccagagaacatacattttagacctttctaaagctattccagattttaagataaaatttatgcctaccagagagcagtactgataaataatgtactataagtacactatttacagttttattttaaataaaatccattcagcatgctagaatggtgaagctttgtcattattttgttgttgtcgacatgaattaaccttgttcaaaaaaggggggcaaaaaaatgacatttgtcatggaaaactttttttaatccctataggacttgaggaacagaatccttacttcagttcttataaatagttgtgctaaacctcaagtttctatcatttagtggccctttccatgctctccatgaa

SEQ ID NO: 48285 - DNA, 304 bp, Homo sapiens
caagatcacaccactgcactccagcctgggtgacagagcgagactccgtctcaaaaaaaaaaaaaaggaaaataaattcttctgtatttttctttcttcaagtgaggccatttaggggaaagtataccataaaacttgctctaagataaggcaaatttggtattataggatgaagtgctatgtgatttgaagtaatgctgaattttttaaatatattaaactaaacaagaataatgaggccctcggaaagtcatgattatatttctcatttttctcattttaaagccacagtgaaaaacacata

SEQ ID NO: 48286 - DNA, 432 bp, Homo sapiens
agagtcaggggcaaggatttgaatcaaaacagtttgagaaattatcccatgaaacacgtgtaggggaatgggaaagtgagaacagagaagggaccaaagccaacacatacagggtacattaatgagcagttaatgccatgtgtagccttcctcccatgatcatatgctggatatagtatggaagctgggatacatgtctatcaactcctgttgggcattacttagttgaaggtcattcctggaggcatgagatctcttctggcctactcttatccaaaggttgggcccacacatatgaatatatcatatactccccacctccaaacttcaggaaatgaaaattaccgtgaccaagtatcatacattctagctttttttttctagtacactgtattctaagttcattaacaacaacagaaacaaaacaaaaca

SEQ ID NO: 48287 - DNA, 931 bp, Homo sapiens
acaaacaaaaacagtaaaaaaaaaaaccaaaaaaacactaccttaattggttattttgattatctcacagtcttccatattaattttttactgatttttgactgacttgtttttcaatataggaatataagctatcaaggcaaagaccccattttctagttcgtttgagtagctcaaaggaccaggaaatttcttgagtttgacaaggaacagcatcatgctgtctaacctgttaaagcatactgttgtcttacagtaaactgttttttttgatacagggtcttgctctgtcttccaggctggagtgcagtggtgccatatcggctcactgcagcctcaaccttctgggcccaggtgatcctcccacctcagcctcctgagtagctgggattgcaggtgcgtggcagcacgtctggctaatttttgtatttttagtagagacaaggtattgctatgttgcccagctcagtaaactttttttgaagacttagaacagcgggttgatattagcactcctagcaatgtgcctgatttagagtcggtgaatggcttaggtactgagatcatctgactcttcaaagggcattaacttctaatctacttgagagtaaccaagtctaaatggtatacaatatgcaaaacaaaatcctccaagttaagtaattatagtattttagaacatactaaaactatgtgagtatttaattattgtaaagttttatattatattagattttatactctattttgaggcaggagtatcatcataaaatagaattaagtacaggcatacctcgttttattgtactttgctttgccatgctttgcagatactgagtttttagcaaattgaaggtttgtggcagccctgtgtccagcatgtctatcagtgccattttcctagcaacatgtacctacttcgttagcattt

SEQ ID NO: 48288 - DNA, 451 bp, Homo sapiens
aatttttcatacagtaagggagaagagattggaaaatgcttatttactggtgatttaagatcctaagaatgtatacatttatgtaggtgttatcttttattatttttaaaaagatgagacaaaagtttcctgagatattcacaggctcttcctgagatagtcaattcagagttcttagggaagatactcattctggaatattcatgggtaaatacatttgtttgttttagggaatggaatttccttaagttgtaaatgaactttgcagttgttaatctgacccatataaaaatcatgtgggctctttttccgaaggaatcttagacctttgtatctgggttatttcacctttttgttgggaatatactatacatcaggaagtatatacacataccttatgtagatagcttgcaggattttcgcaagttgaacacactggtacaaccaaccc

SEQ ID NO: 48289 - DNA, 299 bp, Homo sapiens
gcttgttcagaccaaaaaaagagagcagacttttggcgaatgcgtatttaatttaattgcactgtaggtaagttttatacatcagttttacattctctttagattgcctgcaaatttaattgaagcatgctgttcttaatgaaagcacgtcctttctgtgcatggttttcacagctcatttctatgtttcatagttagccttattttctgttctattatagtaaccagctgcaacgtggttaaagctttttttagagatttaacttgatttctgtggatttttacttctttcgttccaa

SEQ ID NO: 48290 - DNA, 495 bp, Homo sapiens
gagagccgctggatgaaagaagaatcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcatctaatcttacatatacttacgatcttttattttttcattttctaacataccttgaaataattcaaaactaaaagcaataaagtgcatatgaagtgtttgatcataagaaatatttcttactgtaagctgtcagttttatatgccacacctggaaataaaaagaatatcatggaatatttaaaaaatatatga

SEQ ID NO: 48291 - DNA, 562 bp, Homo sapiens
tggccagaggcccagggcttctgcattatcagtccagagctggggctctccaggcagtgggaaagacaggagcaaacaagaggccagcagctgaggagctcactgattgtgagttttcagagcttctgaggctctctctgtagaatgagatctcagattttccctccagccccctccccactctagccatggattttttgcattttagtccatttgcatgcctcttaacttcaaaaaccccgactcccttccatcccaggcccttctgaggaacttgcctaacttctctccccaaggccaggagaaaatgtgaatgagggttgctctgaacccttgcaggccacactggatgctggttagaagtacagattctcagttctaccccagacctacagaatcagaatcttcatttggttgggcatggtggcttacacctgtaatcccagcacttcgggaggctgagatgggaggatcccttgagcccaggatttcaaggctgtagtaagctatgattgtgtcactgcactctagtctaggcaacagagtgagaccccatcaaaaa

SEQ ID NO: 48292 - DNA, 401 bp, Homo sapiens
ctccagctgggcccagtagctcccctggccacttcctctgtctagcttggttgtgggggttgaagggtttggagttgggagttgggatagagaatttaggaatgggagcaagaatattaggagcaaaaatcgggaggcccccccatggtggctcatgcctgttaatcccgacactttgggaggccaaggcaggaagattgcttgaggccaagagttcgagaccagcctgggcaacatagtgagatgctgtctctacaaaaaataagaatattagtgtggtgcagtggtacacgcctgtagtcccagctacatgggaagctgaagcaggaggatcgctggaacccaggagttcgaggctgtggtgagctatgatcttaccactgcactccagcctaggcgac

SEQ ID NO: 48293 - DNA, 202 bp, Homo sapiens
ggaggttgcagtgagccgagatcatgccattgtactccagcctgggcaatgagagcaaaactctgtttcaaaaaaaaaaaaaaaaattttaggaaacaaactagagtttttaaaaattaaaacattaagttaaaatgtggatagtggtaatgagaagctcaatagaagggctggaaggcaaaaggtgtcaaagttacccaga

SEQ ID NO: 48294 - DNA, 269 bp, Homo sapiens
gaaacagggacagaaaaccacagatcctgcattgtgtgggctgaggaagagttgagttccagctcctgaggagaaaacattctccaaagttccgcgccgattccagacagattccccacagctgttgagtcaccagtactttaaaacagacagagctttactacaaatccacttaagcagtttttaaacttcaaacacctgatttgctgaagcaaggaagacttcccctcccatctaaaactgcacttcagtgtcattgcactattcct

SEQ ID NO: 48295 - DNA, 114 bp, Homo sapiens
ctgccgggatccagcctgcttgcccacaactgggtggggccagtcaccaacgacaaacatgaactagatcctggagacatacaaagccctcacaataaagccccagtgggtgca

SEQ ID NO: 48296 - DNA, 767 bp, Homo sapiens
gctagtatgagaggaacatactaccagaaaatataaacaatagatatagctagaaagaaatccaatattatatgtaatttaatgtggtcactcactgagtccttttagccactagtatgctttgtctattctttatattacttacaattaggttaattaggctaattccccaactataaagggctttatgaggctcccctcattgatgtgtagtaggtagatagtcctgacggtgagttggtggatgttctaattttagttttagtttagagcatcactgtccaatagaattctgcagtggtggaaacttctgtgatctttgccatccaatacagtatccaccaggtcacgtggactgttaagcgctcgagatgtggttagtgtgagtgagaataatgcatttttaatttttatttaatttaatttatttattttgagaaacggtctcactctgtcacccagcctggagtgcagtggcatcatcttggctcactgcagcctctgccttatgggctgaagcaatcctcccacctcagcttcccaagtagctgggactacaaacgtgtaccaccatgcccagctatggtgtatcttttgtagagatgggttttcaccatgttgcctaggctggtcactagctcctgggttcaagggatctgctacctcagcctcccaaagtgctaggattacaaatgtgagctgcctcatccagcctaatttaaattttaaatgcaacatctgggtagaggttactgtattaaacagtg

SEQ ID NO: 48297 - DNA, 346 bp, Homo sapiens
ttgtgatccacccgccttggcctgccaaagtgctgggatcactggcgtgagccaccgcacccagcagaatattttttatacacacacactgtatatatgtgccccgtgaacaaaggacaaattgttcaggaatccatggacaaggtgatcataaatagactacaaagaaaaccctgataatttttaaaaataaaaattaaggagaccttattcttcactataaaacaatacaatttaaaattaataacagaagattaagcaaaaacaagcactcaaatacttggatacatgaaatctcataatcattgaattaaaatgatatcaaaagtgctgttttaaaacaaat

SEQ ID NO: 48298 - DNA, 455 bp, Homo sapiens
gctcccaccacctattctgtctcttgcagctgtacagttagccctctgtatccacggattcaaccaactgtagatgaaaaatattcagaaaatataaccaaaaaacaatacaacaattaaaaaaaatttttaaatacaatataaaaactatatagcatttccattgtattaggtatatgtaaataatctcaagatgatttaaagtatatgggagactgtacattggttacatgcaaattttatgccattttgtattgaggacttgaacatccgcagattttagtatctgtgggggtcctggaaccaagcttctgaagaaaccaagggacaactgtacatcaaactaacactggctacagtctgagatagtcttctttcatatcttttatttgctgccacacaatgtaagagcacaaactttcttcttttaaatatttattttccacgaccataaa

SEQ ID NO: 48299 - DNA, 389 bp, Homo sapiens
ttttttgtagagatgggggtctccctgtgttgcccagactggtctcttaactactgggctcaagtgatcctcccaccttggcctcccaaagtgctagaattatatgcgtgagtcaccacgcttggcccaaaaacaatctttttgaaaaaactggggtaaaattcacatgacaaaatttgccatcttaatcatttttaagtgtatagtttagtagcactaagtatattcacattgttgtgtaacagagatccaaaacttcctcattttgcaaatctgaaactctgtacttattaaacagcttccacagtccctggtaatcaatcaccattctaactttgtttctgtcaatttgtctatttttgatacctcatataagttggagtcaaata

SEQ ID NO: 48300 - DNA, 510 bp, Homo sapiens
acatgatctcactcgcaggtgggaattgaacaacgagaacacatggacacaggaaggggaacatcacacactgaggcctgttgtggggtggcggaatgggggagggatagcattaggaaatatacctaatgttaaatgacaggttaatgggtgcagcacaccaacatggcacatgtatacatatgtaacaaacctgcacgttgtgcacatgtaccctaaaacttaaagtataattttttaaaaaagtaagaatgtggcacataataggaaaaaaaaaaaaaaaaagaaagcttagagcaatatactaatccaagttctgaagtgatttggctttaaatcttttctgcctgatgtgatctggaagccggctatggggaagaaggctctcctagaatcttctctctcctccgttttgtccttttctcatccccagttgccccagcttgctgcccagtgtctgacctcttggggtgagaaggggagaagattcctaaggggaagaggggtctt

SEQ ID NO: 48301 - DNA, 999 bp, Homo sapiens
gatcgtcccactgcactccagcctgggcaacagagtgagactccgtctcgaaaaaaaaagcaaaaactcctagcaacatggatctaaagactgtaatacagaagtctgctggtatattcaagaaatagcaaggaggccaaagtggccggaacaatgtgagcaaggaaaaaaattgaagatgaggttacagaggttattggcagagcaggtcacgtaaagcctcacaggacattgtaaggacataggccttggctgtcagtgagaaggggagccgttggaaggtctcgagcagggaaatgctaaaatctgagttacatttgaaaggctcactctcactgatgcactaagaaagaacagaatgtagggggcaggagtaaaagcaggaaaatcaggagcctactctagtaatctggcctagagatataatggtggctcccaccaggggatagcagtggaagtggtgggaagcgttgaattctggatatgttttgaaggcagggccaacggaatttcctgacaaaacaaatgagggtctggtagtgttgagcatgactctgagttttttcgaagttgccatcttctaacatgggcagctggaacagcggccttaaggaagatcagaagtctagtgttggatgtgttacgtttgagatgtctatgcaacatccaggagatctacaaatttctaacttccatgtcagatgagcacagcatattgtattcagcattttacttatttcaatgaggagttagggtttccattctgccataataccagaaatgaagtgcttctgtgacttctttaatgtgccctcatataatgtttattctctcttttagtaaccatcagtgctgtccttcaaaccttttctaatctacaacaactattttaagatataatgaacaaaactggaattagtactccaataaatttctgggctttaacaaagacagcaaggggactcctgggagtttccaaacatgatgtctttagaatgc

SEQ ID NO: 48302 - DNA, 660 bp, Homo sapiens
ggttaatttgctcagtctgtttgctcacagactcagcagatggccaagctggtacttaggccaaggcagtctggccccaatgcccatgctgggaattgctggggatcacagtcctctgtgcctctctcaccacaaaactggaacctcacaaactccctgccactaggcagggcctccccagcccctactggcctgccccacctccatttggactggcacatttggactgggccatcacattcccctcagaacagccctgataaatgtaccggtgcatgtgagtacatatatgcatgtgcacgcatatgtgtgcgcctgtgtgcacgtgtgggtgggtgtttactatcaagaagcaacagacagccgtgagcctcactcaccccaactagggggtgggaagcccaggggtggggcagatgtttgctgtgagcattactcaagagagagaagatgacttaatggcttgcatttcagccacatcaaaaagccctgcgccaacgttaaaatcacatcccattgccaccagccccataaagggcttccctggacgtgcccgatttccaaagcctaatctttgtagtcacatctccacctctatctgccagtgttggggcccctctggggcccagcagcgctaagacaggaggaaggcacggggct

SEQ ID NO: 48303 - DNA, 607 bp, Homo sapiens
ggttaatttgctcagtctgtttgctcacagactcagcagatggccaagctggtacttaggccaaggcagtctggccccaatgcccatgctgggaattgctggggatcacagtcctctgtgcctctctcaccacaaaactggaacctcacaaactccctgccactaggcagggcctccccagcccctactggcctgccccacctccatttggactggcacatttggactgggccatcacattcccctcagaacagccctgataaatgtaccggtgcatgtgagtacatatatgcatgtgcacgcatatgtgtgcgcctgtgtgcacgtgtgggtgggtgtttactatcaagaagcaacagacagccgtgagcctcactcaccccaactagggggtgggaagcccaggggtggggcagatgtttgctgtgagcattactcaagagagagaagatgacttaatggcttgcatttcagccacatcaaggcttccctggacgtgcccgatttccaaagcctaatctttgtagtcacatctccacctctatctgccagtgttggggcccctctggggcccagcagcgctaagacaggaggaaggcacggggct

SEQ ID NO: 48304 - DNA, 564 bp, Homo sapiens
tgccaattctcacactcatctgtgctgcccaccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagaggcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcagacctaggagggtggaggttgcagtgagccgagattgcgccactgcacccagcctggacaacagagctagactccatctca

SEQ ID NO: 48305 - DNA, 846 bp, Homo sapiens
cttgtttatccattcactcatacgttgtttccttttggggatattatgactagcattctacgaatatttttctggaagacttttgtcttgttgtagaagatgttttttttctcttattttgagtaaaaagtgagaggaattgcaggaacacatataagcacatgcttattttttttaaagaaactgttcaactattttccttagttgagaattttatactcccaaaagcagtgatgtaccagagccccacttgtttcacatcttcagcatcacttgcaactaatcaatcttcaattttagctgttcttctggctttgtaatgacatctcattgtgcttttgctttgtttctatctgatggatatagatgtgaaacatcttttcttatgcttactggtcattggtattttttctattttgaaatgtttaagtccttttgccaatttttattgggtttatcccctcattgacttgtaagaattcttatattcataggtggaaattgaacaatgagaacacatggacacaggaaggggaacatcacacaccggggcctgttgtggggtggggtgagcggggagggatagcattaggagatatacctgatgttaaatgacgagttaatgggtgcagcacaccaacacggcacatgtatacatgtgtaactaagctgtacgttgtgcacatgtaccctaaaacttaaagtacaataaatataaaaagatacatatcctatgtattttcaatattttctcccagtttatatcttactttgatttttaaaatgttgaatttcaatgaatctcagcttattaatttatttccatcttatcaaataaatatttcc

SEQ ID NO: 48306 - DNA, 436 bp, Homo sapiens
gagtgcttcccagtgtctccaggctcccctctctgggccctttctcgccaactaactgccattctaacttgctttccatcacattagtcttttcttccctacccactctttcatagatactttgccaccctccagtaacagtttgattcagctgagtaagatttttttgttaagttcaatgatgaatctgtattggttgaaacacacacgagggttcgtcctgttgggaacaggcatcactcagtgggatcacacagtgtccagtctgtccttatccttccatgtccagccctgttttctaaaaagggttccctccatgcagttttcgaatccttctccaaaaatcaaaagtcattcagttggatgaaagggaaaccaaacgagcatttacaactctgccactgcattagtattcattcgataattaggtggaaag

SEQ ID NO: 48307 - DNA, 440 bp, Homo sapiens
ctgggcaatttttaacatttgatttatgtcaaaaaatagccccccaagtgtcctgccttggggtaaacagggttatggggttactcgtatctgcccttaaggaacaagttctacccctgttcttccctccaggctcctggtccacccccaacttccagcagaattgtctaggaactactggataccaggatacagtaaggaagagattagatctgacacaatgtttacttagcaacagcaacaaaacaacagcagtagtaacagtggaaataggttccgtggtttaagagtatagagtctggaatttcatcttcaagccttggcatcaccatgaattcactctgtgacttatcttctctcaaccttagttttctcttctgtaaaagagataagatacttcgcccaatagtacacattaaatgctgtatatataaaaaaaa

SEQ ID NO: 48308 - DNA, 476 bp, Homo sapiens
tcatcctcccacctcagctcccgccaccaagtagctgggactacaagcacatgccaccacatctggctaatttttgtattttttgtagaggtaaggtttcacgatgttacttgcccaggctgatcttgaactcctgagctcaagcaatccatccactgcagcatcccaaagtgctgaggttacaggcgatagccatcgtgcctggccgaaaataactttttttaaaagactttcaatatccaggtaaataatcatttacacatttctccttgccagccaatctgcaggcatagagacagaccacctcttttctactagaatcccactaacccttaagcggctaaggcagggtgggaagaaagatgttaccaatcaaggatcataaagaaaaaacactgtttgctttaaaaagagaaaacaaattctctatttccccctttaaattaagtatagggagcatacaatttccacagtaa

SEQ ID NO: 48309 - DNA, 256 bp, Homo sapiens
ctatatctatatctatatctatatatctatatccatatctatcatctatatctatctatatttatgtctatctatagacagatatcctgtggacttcgtttgtattttgtatccacaaatgctttgaatggccagataacatctaatttattcctttttggggggcttttattttaagttcagggatataagtgcaggtttgttacataggttaacttgtgtcatgggggtttgttgtatagattatttcatcatg

SEQ ID NO: 48310 - DNA, 242 bp, Homo sapiens
cttgatagctgtatgctaaaagtgaggttttttttgttctgttttgttttgttttgaggtttgaggctttttttccccttatcaactcaagtctttcctggttatcctgggctgtcagtatttggttatggactacattaattacttagcgtacagaggaaaagatgtgtgttttagataaaaagagctattgcgagctaaaaattattaacagatggccaggtgcggtggctcatgcctgt

SEQ ID NO: 48311 - DNA, 434 bp, Homo sapiens
gctcagttacggtcattttaactgttttttcctaattaccctaatattttgaccttcataaaagcaagatctggatcctatattttactgaattgccttacttcccatcccagtgtgaactgccttagaaaatgctcaattgaccagttgcagtgggtcagcctgtaatcccagcgctttgggaggcccaagatgagatgcacacttgaggcccaggagttcaaaatcagccctggtctatattgtgaaacttcatctctacaaaagaaaaaattaacatgattgggtaacacacctgtagtcccagctactgggaaggttgagatgggaggattgcttgagcccaggaggttgggactgcagtaagccacgattgcaccactgcactaccaggtctgggtggcagagtcaagaccctgtctcaaaaaaaaaaa

SEQ ID NO: 48312 - DNA, 361 bp, Homo sapiens
actaaaaaagaagagaaaacagattctcctttaaatcctccaaaaagaatgtggcatccaggttttaggacttctgaattataagataaaaagtatgttttaagccaattgagtttagggtaatttattacagctgcaacaggaaactaacacaacccactacatgccaagtacagttatatgctgtgcacatgcaggtagcataccggaaagttttggtttggttattttaaattgtaaggttaaataacctataatactgggcatataattaccatttatctccagggttctttggaacctaaaattcagagattgctaggaataatttactcccaaagtcaaataaaactttatctgg

SEQ ID NO: 48313 - DNA, 369 bp, Homo sapiens
cacattaaagttggcctcttctgtcccatgtggaatcttcctgttacaaggatacatagaattgtagttagggcccatctagataatcccaggataagctccatatgtcaaaattcttaatttaattatacctgcaaagtcttttttttttttcatttaaattaatattcagactccaagagttagaacgtggacacattttgagatgtcattattcagcccaccacaccatgtttacctttgtacctctctgcattcttcccttgttctcccttctcctttccgctagcactgtcagccaggccaagaaaaaacaagagttgtccaaaggcttaactttcctgtccgcactttgtattttagtaaaaa

SEQ ID NO: 48314 - DNA, 417 bp, Homo sapiens
aaggataccagggtccttccattgcaggagagtattatgagtggaaaccatggtctggagcctagatgtacttgctgccactgaggtgttgttagtcctagttgctatcatctgacagcaaggaaatacgtgtgtataccagcctgtgtatatacatatatctataaatgtttctctatgaaaccatccatattcatattaaggtaaacatgagtttatgtcaccaatgatgagccgtcatcacgtggagtattctagctcctccagttatctcgaaccttccatttcaatcgtgagaaatataactcctaccatttcaccatccatttattttaatcgttcaatttcactaggacatgcatagtggtcagaattattaacctgtacccctgtgggaagcagctttatcagctagag

SEQ ID NO: 48315 - DNA, 352 bp, Homo sapiens
ataattaatgtcggatttgttaatgtaagagttgcaatctgttgctgggttctgtctcaaattaggcaagaagggtggctgaggggccagccactcagttatataccaagacaagaggtgatttgggcactgaggcacctgccatgcactcctccatgaacactcagcaccttacccttcagggtctgtctcctcacactgtaccgtgagctcccctcagtcctcacttgctgctgggacctcagggctggacagggctgcttcattaagctggcccagctcttcccaatttaccttcaactaacatttgttcagcacctaactggcaccaggccctatggcaacagggagg

SEQ ID NO: 48316 - DNA, 1029 bp, Homo sapiens
tgctctggtgactacagcaggtcaattattggagccaagagtagtattgtaaagttggagggtcttagaaggtcaggaaagaaatgagtggcccatggaagtgtcccttaaatgataacagccaaaagcacagccacctatggaatattcctttgttttgctggactggtagaaagtgcagggcttgcaagagtagaaagttagagccagtctcatccaatgtcctgtgaaattctagtgtttctgttaagtgcttgccggggtcttcttgaacccctccagctggggaacttggtagaaacagccccactgattctgttttttaataaagtcctttttagttgtacaagcaaactggtagctctttaatgacgtaaaaattcaaacaagacagataaagctaaatatgcctaaaactactatttactctgatcctagccatctctctagaagtaattactggaatagtttgttggtatcttttacccacttcaatacgtgtatgtacaaaagtctgtgttttttttatgtaaacagatcacattaagtgccttctgcatcttacattcttttttatctttgcagtaagtacatcctagagatgttttagtacacgtagatttactgcagttttcttactgctccatgataatcccgtggtacagatgcactattcccctgttggtggacatttaggttctttctttctatttttgccattatctgtcccctgagtttttttagacagctctagactttaggaaatttgcaccttcatcctcagaaacagattctggcttccacgaaagtgctgcagaacccatttgtggagagcccacgtgtcttgtccagtccttgtgttgtatggacgaggacacacacacacacacacacacgtacacacattatttattgtgacttcttttgctggccactgtgctaaacacagttatctttttcctcaaaacaaccctatgaagtaggtgctgttattatccctgcttgcagatgaggaaactgaagagtaaa

SEQ ID NO: 48317 - DNA, 891 bp, Homo sapiens
ggacggcgtcgtagcggcactccaggccaggccactgcggtccattcctctgccctgcgtttgtgggaaatacgagcccagtgccgcagctttagggcctgggtcgcccttggtccgcccgccgcgttcccgggtggtgtccccacgctgctgaggagctggttccgcgatgcctgccgcggggggcactccccgcagcctgcgaccgtcctgcgtccttcgcttctgggcgtttccttctggggtttccttggagcggctcgagtcgactcctcccgcctgcccaactcagctccgctcgccactgggtccctgcagccctgcaccctcggggcgctcattgtagactattcttggtccccaggggccaccggtccctgcctggcgtggcaggaaagcgcagactggacacaggggtcggagcctagggaaccatcgagtcgcagcggccggacccaccgggggtctcaacagctgaggactgtctgactattgcctcaatgtcgccgacttgggtggcctcccagctgctgctgagggacggtgcgaagtcctagtgcgtttttaagcagactcctaagtctgcgcgcgagtcggggcgcggcgccaggtcaggccgcctccgtcgccaccgagccgcggcccagcgcagagccccgccatctggagctgacagtggccattgtgaaggcaggaggccagggccgcgccacccgttgcatcccgcggcaggtctgtgtcgcctggttctcggcgccaaaggctggtcccacagacggcttccgggagtgatgcgtccccacgagcatcctcctcttccttagcgacccccggactgcagagcttcaagaccagcgaactgtttcccaagaaataaaattgtaaattagg

SEQ ID NO: 48318 - DNA, 427 bp, Homo sapiens
tcattcattctgactgagccaaccaatgctgcagcatatgggtgcagtagacaagctggctcctgttcctcaaatagaccctactatacagtcttttgaaagattaagatgtattttagtgttaaaaattaaaatattaaaacaacacccacaccgtgtaagggaaaaaaataagaggttggagaagaaagcacctcatctccttaaggcaggtccaggggcacccccatcccccgccatgctgaggctggccaagggtccggggcagctgcaggtgccagggcccctggtagggcgggggcaagctcaacccttctgcttcaatagcaggcaacagcaaggcacacacacacccacgccgtcttggagaagggccccttcaggatgaaggctgcagacagggccacccagctgtgtagcgagtacc

SEQ ID NO: 48319 - DNA, 381 bp, Homo sapiens
gaagaaaaaagtattataccttgacaccaatcattccagctactgtagctgtgccattttgggtatataatttctttgggaaatcgaaagaatgtcaagtatgtgaaggtaattgaggatggctgcagaatggaatgtatgtagatcctcaagtcatttcaagtttccttcctacctctttctcaaagaagcacatggatcagatatggtgaaagttgagggaggaggcatggtcaggaagagggaatatgttaaggctcagttgcaaacgttgtgttaacttaccctagccactaggtagatctagggtgatttaattgtcttaatctaaagactaatgtacttaaaatgatctactaaaggtgaactatttactcccat

SEQ ID NO: 48320 - DNA, 727 bp, Homo sapiens
attcagtgtaaagtgtaagtctagtgggcctagaatcttcttacctgctgagattgtctaggctcctacaacctcggcctgtagacttaagagaactgtgtggagcatggaatgagatttttgccccctccctccctgtcttccttcctttctcttttttcgttttgcagtaattagtgttggttctgtctcttttcctgtctccacacacacataaacacatccttagtcttccttcctttcattgtaaatgatagcaaactgattttgactttttccattttctttatatatgaagatataacataaatatatagatgtaagcatttctgaagggcaggaaagctggtaggggctttatgaaatctccatgaggccagtttcatgacttagcagccccacagggctggtcttcagatccaaggcgatgggctgcagggcctgcaccttccctcttggcagagcggtgccacagaggtgcagagctgctgcgctgggcaagacctgctcctgcacaggacttggagtaggggcctgtgccgagggcggtgctgctcttcctggggccctcaccagcctgtgctttacatagaggcttgtaaagaagcctgcgagacaggagtgtgttcagaatatggacagggtcagccgattacagcctgaggggtaaatccagcctgccattgaattttgtaaataaaaatgtatctaaacacaaacacaccca

SEQ ID NO: 48321 - DNA, 1016 bp, Homo sapiens
gtactcatattactataaggaaacaaaaagaaagaggagctaatctgcaccgactctcttatctaccaccgctacatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaaggggtaagtagctattgttgagggagggggtgggcaagaattagagaaaatgaaagaggtcaaggagcagatttcaaatgagtgaatgagagcctcttcatattgcctggtcacctggagaccaatgcagccagccatgggctggggtagatatctgcttgatggtgacaaggcatcacgagaagtgacagagggagcactggagctttcttaagtggatacatgtgtaggtcaggaaggaaggaggtcctgagacaaccacaccaggttcccatctgcagagccacctacctccccagcacacaaacttcgggctcctgtcgaaggaatgagcttctgggaccgctgggtaagcaggtatagaagagtctcctttttcatatacacaggatgttgccctgttgcccaggcttgagtgccgaagtatg

SEQ ID NO: 48322 - DNA, 656 bp, Homo sapiens
gcctgttctgagcctcaccctatcagtcagtagagagagatgtccagaaaaaatatctttcaggaaagttctcccctgcagaattttttttccttgttaaatatcaggaatataggcgtgagccaccgcgcccggcagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaaggactatcaagccacaaaccagaagctgcaggcttccaccggcttgggatcatcttgtatcagcctttgcccaaaggggagaatcaaagaattgaaagtatgcgaccctttgaggcccttttgcgggtccgaatcca

SEQ ID NO: 48323 - DNA, 1154 bp, Homo sapiens
gctagggacagagggcctcctaacggtaagcctcaggctcttcaaggccctccgtcaagcaatggtaggaggcctccatatttcacccacccttaggccagggaaaaggacttctccagagttgctttattagtttgctagggctgtgataacaacaacagcaacaaaaccacagtctgggaggctaaaacaatggaaatttatttccttatgttatgaaggtgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaa

SEQ ID NO: 48324 - DNA, 895 bp, Homo sapiens
agcggagttggaccaatggaagggtctccagcaggacccattgagcagaaggaggccaggtgggaaagctcctgggaagagcagccagactggacactgggctgcttgagtcctgagtcacacaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaa

SEQ ID NO: 48325 - DNA, 1135 bp, Homo sapiens
  misc_feature (1087)..(1087): n is a, c, g, or t
gcctgttctgagcctcaccctatcagtcagtagagagagatgtccagaaaaaatatctttcaggaaagttctcccctgcagaattttttttccttgttaaatatcaggaatataggcgtgagccaccgcgcccggcagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaaaataatccctcagtnaaagggcaagccccccccgtcgccgctgggcgccgccatatacgcgaa

SEQ ID NO: 48326 - DNA, 1113 bp, Homo sapiens
gcctgttctgagcctcaccctatcagtcagtagagagagatgtccagaaaaaatatctttcaggaaagttctcccctgcagaattttttttccttgttaaatatcaggaatataggcgtgagccaccgcgcccggcagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaaggggtaagtagctattgttgagggagggggtgggcaagaattagagaaaatgaaagaggtcaaggagcagatttcaaatgagtgaatgagagcctcttcatattgcctggtcacctggagaccaatgcagccagccatgggctggggtagatatctgcttgatggtgacaaggcatcacgagaagtgacagagggagcactggagctttcttaagtggatacatgtgtaggtcaggaaggaaggaggtcctgagacaaccacaccaggttcccatctgcagagccacctacctccccagcacacaaacttcgggctcctgtcgaaggaatgagcttctgggaccgctgggtaagcaggtatagaagagtctcctttttcatatacacaggatgttgccctgttgcccaggcttgagtgccgaagtatg

SEQ ID NO: 48327 - DNA, 1102 bp, Homo sapiens
gcctgttctgagcctcaccctatcagtcagtagagagagatgtccagaaaaaatatctttcaggaaagttctcccctgcagaattttttttccttgttaaatatcaggaatataggcgtgagccaccgcgcccggcagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaa

SEQ ID NO: 48328 - DNA, 1159 bp, Homo sapiens
agcggagttggaccaatggaagggtctccagcaggacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaa

SEQ ID NO: 48329 - DNA, 1005 bp, Homo sapiens
gtactcatattactataaggaaacaaaaagaaagaggagctaatctgcaccgactctcttatctaccaccgctacatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaaaaaa

SEQ ID NO: 48330 - DNA, 1124 bp, Homo sapiens
  misc_feature (1089)..(1089): n is a, c, g, or t
gcctgttctgagcctcaccctatcagtcagtagagagagatgtccagaaaaaatatctttcaggaaagttctcccctgcagaattttttttccttgttaaatatcaggaatataggcgtgagccaccgcgcccggcagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaaaccgatgcggcaagtcntcctctctccccgcgcgatatgtgcgggaaaaaaa

SEQ ID NO: 48331 - DNA, 522 bp, Homo sapiens
agcggagttggaccaatggaagggtctccagcaggacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagagctgcaaggctccaagtgtcgcagctgacgtcaggacgtccatctcatcattcgatactgatcacggttccacattccc

SEQ ID NO: 48332 - DNA, 1197 bp, Homo sapiens
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48333 - DNA, 965 bp, Homo sapiens
cattccttggtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48334 - DNA, 1206 bp, Homo sapiens
  misc_feature (1195)..(1195): n is a, c, g, or t
  misc_feature (1200)..(1200): n is a, c, g, or t
  misc_feature (1206)..(1206): n is a, c, g, or t
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacacgtgcagcgtagaatgggatcctctanagtgncactcn

SEQ ID NO: 48335 - DNA, 790 bp, Homo sapiens
  misc_feature (16)..(16): n is a, c, g, or t
accaaatgtctgaacngcggtcctctcgtactgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48336 - DNA, 325 bp, Homo sapiens
ctcggctggtagttgctgaccttgtaggagtgatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48337 - DNA, 211 bp, Homo sapiens
  misc_feature (27)..(27): n is a, c, g, or t
aaaggccaggctgcccagggccagccncactcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48338 - DNA, 1131 bp, Homo sapiens
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48339 - DNA, 1356 bp, Homo sapiens
ggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgga

SEQ ID NO: 48340 - DNA, 373 bp, Homo sapiens
ctatcagctgtcgttctctgaaatttaaacctagacaagaagcttctgaattttactaatattaaaacagtatttgctatatataggaaacaaaagctatataactacagtagctgaactaaaattataaataggaagaaaagtatatttaaatttgatcatagatggttgacaacaattactaaaatccttaagacttatgattacccccttttctaatctaccgttaaaaaaataatagtatggaggtttagaaggaggaagttgtgaaagatatcatagaggcaaacctacaaatgcttgtatagtaagtgttccctatttagtctagcatgaaatcataagaattgttatgtactctaataatctattt

SEQ ID NO: 48341 - DNA, 540 bp, Homo sapiens
atcttaattaatgaccctccatataaagagaatattatgaaatcatcaagaattcatcatgatcaaccagtgaagcccttggatcgagcagtcttctggattgaatttgtcatgcgccacaaaggagccaaacaccttcgagttgcagcccatgacctcacctggttccagtaccactctttggatgtgattgggttcctgctggcctgtgtggcaactgtgctatttatcatcacaaagtgttgtctgttttgtttctggaagttcgctagaaaaggaaagaaaggaaaaagggattagttaaatctgagatttgaagctggaaaacctgatagatagggatacttcagttgattccagcaataaatattgtgatgcaagatttctttcttcctgtgacaaaaaaaaaaaaatcttttcgaaatctaccttgtcaagtaaaaatttgtttttcagagatttaccacccagttaatggttagaaatattttgtggcaatgaagaaaacactagggaaaataaaaaataacataaagccgt

SEQ ID NO: 48342 - DNA, 491 bp, Homo sapiens
atcttaattaatgaccctccatataaagagaatattatgaaatcatcaagaattcatcatgatcaaccagtgaagcccttggatcgagcagtcttctggattgaatttgtcatgcgccacttcgagttgcagcccatgacctcacctggttccagtaccactctttggatgtgattgggttcctgctggcctgtgtggcaacacaaagtgttgtctgttttgtttctggaagttcgctagaaaaggaaagaaaggaaaaagggattagttaaatctgagatttgaaatagggatacttcagttgattccagcaataaatattgtgatgcaagatttctttcttcctgtgacaaaaaaaaaaaaatcttttcgaaatctaccttgtcaagtaaaaatttgtttttcagagatttaccacccagttaatggttagaaatattttgtggcaatgaagaaaacactagggaaaataaaaaataacataaagccgt

SEQ ID NO: 48343 - DNA, 2554 bp, Homo sapiens
tttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtatggatcttcagtaacctttttatttcctagatgattgaaatataggtatttactccatttaaaccaggtgataagatgatgtaaatactcagggagggtattaacttgttacttttgctcgttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaggttcaattacaccacttttgtcaataagcaaaccaggtatttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccacacccggctaatttttttgtatttttagtagagacggggtttagtagagacggatcactcctgaccacgtgatccgcccacctcggcctcccaaagtgctgggattacaggcgtgagccaccacccccggcctgtattttcagagaggagagcttggtgtttttgtggtgccaagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttaacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaaaat

SEQ ID NO: 48344 - DNA, 1525 bp, Homo sapiens
tttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtatggatcttcagtaacctttttatttcctagatgattgaaatataggtatttactccatttaaaccaggtgataagatgatgtaaatactcagggagggtattaacttgttacttttgctcgttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaggttcaattacaccacttttgtcaataagcaaaccaggtatttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgttttttttttttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtatcaacatattgggtgtacggtaaaaaaacaaaaaaaaaaaaaaaaaaaaaaaaatattgtgtggggcgcgggcaggggcctcagaaaaaaggtttttcagaagccatttgcgttggggggcgggggcccagatagttgataaatgggacactggggcaaaaggggtgtccaaaaggaaaacccggggtaagagcaaaggggttgtggtttcctcagcaa

SEQ ID NO: 48345 - DNA, 2500 bp, Homo sapiens
tttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtatggatcttcagtaacctttttatttcctagatgattgaaatataggtatttactccatttaaaccaggtgataagatgatgtaaatactcagggagggtattaacttgttacttttgctcgttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaggttcaattacaccacttttgtcaataagcaaaccaggtatttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccacacccggctaatttttttgtatttttagtagagacggggtttagtagagacggatcactcctgaccacgtgatccgcccacctcggcctcccaaagtgctgggattacaggcgtgagccaccacccccggcctgtattttcagagaggagagcttggtgtttttgtggtgccaagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatgatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttaacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaaaat

SEQ ID NO: 48346 - DNA, 479 bp, Homo sapiens
aatacattttaagtatccccaacacagttcggaaaacaaaaataattccccttccatacttatgtacaattttttccctcttcaggctttttcatttaacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaaaat

SEQ ID NO: 48347 - DNA, 320 bp, Homo sapiens
caggatgcagttaaacaacttgggatttatccagttgtgttctactgctgttaagtttggtgagaatgtttggcaattagtgggaggacgcagttcttcgtcaagaaaacaattttcagaaacagctgattttctctggaaaacatcaggccccactgggagtcgaacccaggatctcctgtttacgagacaggcgctttaaccaactaagccatagagccacgcggaagcactctttagaggtgaatctatctcattttactttgacaaaatgagtttagttagttatctgctgtcttcaaaaaatatgtcaactcgag

SEQ ID NO: 48348 - DNA, 706 bp, Homo sapiens
taagtctgatttaagtctttccatctttaatttaaatccatttctttttactctgaccccagtgactgtcgttgagtgtgtatttgcccgacttgccgtgccagattggtaggcagtggtttggaatcttcattttaaaatcctgtttttctctctccaatacccttcactgcttggtaagtttttatacttctcaatgagacccagagtctcgtgacctaccatttgcctccttcatgatgaaacaactcacaagttggtagatagcctccagttggcagaatcctatgtataatgtgtctttaaaacttgaagagtttgaaggtattatagccctggagcagtaagttttatggctataccttggtaataagacatttgaataacttggcttagcggctttggtaattaactgtgatttttggaatccacctcccctgctgtcagcttgaatcttcattttagtaacacactattactaacactaaacgcttattacatgtgtgtttcaagacaagcgtgagggagttgctcaccctggggtccaaatgaagcagtcagtggcaacccatgtgtagtggggaatggccagaatctgccggggccacttggtgggctgccttgctcttgattttcagcaggaagctggtggaagctggggttgggcatctgtctctgctcaacttctcagtcagaaaggaaggag

SEQ ID NO: 48349 - DNA, 454 bp, Homo sapiens
gaaatgaagttgtgtttgaggtgagatgagactggacagctggcgttggcaccagaccttgtcttaggtttcatctcctccgacgttgaccaaagcctttgactgcacttgatgcccagttctcgctccatccctctccatgaaatggcattgggaagtccagcattcagatattgtgttaaatctccctttagagactggcctggctgccagtcccggcctgctgcttattggctctgaggcacagtatattgttggcagccccaaccccctaccactcactctgataccgctgtccatgatcactaaagcacacactaactggaagtgtcttgttgcacagtttatggccggaatgtcttaatttttcatgactgggatttcagtgtgtgtagatctgtgtatgcttgtatttcttttagacatttaatggatattcttggtaagaagtgaa

SEQ ID NO: 48350 - DNA, 613 bp, Homo sapiens
tgaatattattttaaacatcatctaggtcagattagcggcctgtgaccaacttggaaacaaattcctcattcttttctgccctggtgtcagctcctgtaagcctgcagattttatgccaaataaaccgctggagcaaaaggaaaggcagccagcctctcccggaatttgggagagggataccttgttaagaaaacgttctacaacttacgaattagatttaactgtaaaaaatagcacgtcctcttttaccaaacaaacgtactagttagggaaatcatcttgcttcagatttaagatagttctttttttagtgcttgtaatatcctgctatataatcttcataagaaacgtgaagggttaggaaaggtttagccgtgctgtccagtattgggatttaaattttaaatattaacttaattcctcagtggcaccagccacatttcaggtgtgccataaccatgtatggctagtggctgctatgtggcaaagtacatatgtagaacgtttctatcatcgaagacagttcttttggacagagccggccgagaggattacaatacttggggcagaaaagtgtccttaatcacataaaataatgaaaaccctagccag

SEQ ID NO: 48351 - DNA, 371 bp, Homo sapiens
gaagtataactagcaggaatgtgtacatatgcccaccaaaagacattcataagaatgtccagagcagcattacttgtaacaatcacaaaccaaaaagataccaaatggccatcaacggcaagataaattgtggtatatttatacaatggagtacaatatggcaatgagaatgagcaaagcactgccatttgcaacactaatgaatgaatcccataaacatactgttgggcaaaagaggccggtgaggccagggatggtggctcatgcctgtaatctcagcactttgggaggctgaggtgggtggatcgcttgagcccagaagtatgagaccagcctgggcaacaaagtaagatcctgtctctacaaaaagt

SEQ ID NO: 48352 - DNA, 275 bp, Homo sapiens
caggatgtctgtcattctgtctggaacctgctgttcttggtcccctgctgtggctcccactggcagtagagggagcgcattgccagatatgaaggaaactcatacttgagtatgagtatggtatgaagagaggagctgtcgcaaggatactccccctgcatattccagaagcccatcactggattccctagatccatttcagtaccccacatcccaaaaaggaggactagaactaagtatgtgtaaatatgtccacatctgtaatgagccaaatt

SEQ ID NO: 48353 - DNA, 437 bp, Homo sapiens
taaaattaagaggcctgagttttaggctgtcttagtggtgggacctcagacccatagtttgcgtgttttctggatatgttctctcatagataaaatgagaggcttggagtagatgggcctgagccctaggggtttgtccaggtgtaacatcttattatagtattgccaggactcttagaatcatggagggtgaggagagagaacatttgcagttgagaattacaggggaatttctttttctctttttctacacttttctccactagcatcttgtttgtgactagaattaaatggggggacatggaggtttgttctctgcctccttgagtaggatgacagaggtgctttcttcgaaagtctgtgtgtcaaagttttatttcagcactagcctcttgtgaattgccagtcacctgtctgttcctggtaggtaggggcag

SEQ ID NO: 48354 - DNA, 249 bp, Homo sapiens
ccaaagtagaattgggcttatcagaagtaaattactcactttctagaaacaagcatagtgtattagaataagacccacacaaggcgagacaccagcactaccactagagcaaactacaaaatccctaagccctggatggcacaaggatcacggttaccactgacccctctctgcctacccttgaaaaacaacaggctaggcatagtggctcacttctgtaatcccagcactttgggaagccaaaatggt

SEQ ID NO: 48355 - DNA, 466 bp, Homo sapiens
aaaaagacacacacatacatatcccatatgaaagttgtggacatcatgatacttcaattctaaatatttatacgctagtatttctttctttttttgagacagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgtttgctgagcttctgccatgtctccccagtgtctgaggttgtgagcatcttggttacttgctgccaa

SEQ ID NO: 48356 - DNA, 509 bp, Homo sapiens
aatacagtggcatgataacagctcactgcagcctggacttccctccaggctcaggtgatcctcctgcctcagccttctgggtggctgggactataggcctgtaccatcatgctaatttttttctatttttagtaaagaaggtgtttcgctatgttacccaggctgttgaactcctgggctcaagtgatctgcatgcctcagctccccagagtcctgggattacacatgtgagccaacaccatgctcagctttaactgttatttttgaagaccagattaaaataaattttattagaaaactctcaagatttaaataaaataattttttttttggagacagtcttgctctgtcgctcaggctggagcatggtggcgcatgcctgtaatcccagctactctggaggctgaggcaggagaatcacttgaacccaggaggtggagttgaggtgagccgagatcgtgccattgcactccagcctgggtgacagagtgcaactcagtctcaaaaaa

SEQ ID NO: 48357 - DNA, 427 bp, Homo sapiens
gttacattgcttgagtatttcaaaactgggataaatccaaatttataaatgttttataagtctggtacattcttaaattaaaaatttttttacaaaaaactggtcaatggaaattaggggaacaggccatgcctgcattctattaaagaataattcctatgtaaaactgcaaacagatggtattatatagtcttagaaaaatggtagggttgatatggtttggctgtgtacccacccaaacttcatcttaaagtgcggctcccataatccctatgtgtcatgggaggaactcagtgggaggcagtggaatcatgggagtgagtttttcccatgctagtctcatgatagtgaataagtctcatgagatctgatggttttataaaggggagttctgctgcacaagctctcttgcctgctgccatgtaag

SEQ ID NO: 48358 - DNA, 544 bp, Homo sapiens
aaacgggtccctggtgccaaaaaggttgggaaccactgctctaaggtgtccagtgttggctgacccctctccctacttatgcacccattggcttgcctaacagctgattgatttctgtttaaatagacacagtatattggggcagtttattgcatctttggtcatctcttttcctctgggtccctaggacggaagacaatatcctaagttgattctgtctaacaaaacatgagtaaaatgaggaattggttaggtaggtggcaaacagcaaagattatatggacttgtagcttgctccataagtagactttaaccaagtaagctatttgaaaaacaatcttaatttttttcaagtgttatttttaattctataggaatattttcataaaaataatgatgtccattatgttagcaactagaattacaatggcaagttttaggagatgcttgaaatgtgagatgttacatttaaaactataaagttatcgacctaagtatatgattgtacccatgtggcagtaaacttaaaacttccagtttcagg

SEQ ID NO: 48359 - DNA, 171 bp, Homo sapiens
attgttaacaaattctatgtatttcagtaatctacactaatacagaagtcagtgtaaaattcagaaaatttcattcaaaacttcatgacactaatatgattcattcaaaataccatacagatgtttacatacttatttatcttattcaacatatttataactagcatatcc

SEQ ID NO: 48360 - DNA, 205 bp, Homo sapiens
atatttttcttatttttccaaacagtgctggcatatttttggatatattacacaaaatgtatgacaaaattctaaatatttaaaagaccttggcttcctgaccagtgtaaatttgtattttttatctccattttaaactgaattataaatttctgtgtaaagttctgtaattattttttcaaaaatatttgcaatgtttttgtca

SEQ ID NO: 48361 - DNA, 431 bp, Homo sapiens
cgcgcgccaccatgcctagctaatttttgtattattagtagagatggggtttcaccatattggccaggctgctctcaaactcctgacctcgtgatcctcctgccttggcttcccaaagtgctgggattataggtgtgagccaccgcccctggctgttagtggtattttaaaaaattatgtctaggcatctataataaggctgtatgtattggattgctgtgaagagtcaatgaattaataaatgcaaagtacctcaaactgttatcacataatacaggtttagtaaaagttttccactattatcagtgatatactcattatcataagtatcttcattaggatttatggaaaggattttaaccatgttgtttacctttggcaaatttgtaattcatggtggaaaaagagaaacacttgtaatgagtataacg

SEQ ID NO: 48362 - DNA, 692 bp, Homo sapiens
  misc_feature (1)..(1): n is a, c, g, or t
nttttttgagatggagtctcacctccgccgcccaggtggagtccagtggtgcaatcttgtctcgctgtaacctctgcctcccgggttcaagtgattctcctgccgcagcctcctgagtggctggaattagaggtctgagccattgtacccagctacatttatatgacaattgtttattctgcaatgagatcaactgaaagtgagaaccactttctgtatttccttttacatgaggatgcctgaaaaaacccttaatagaaaaactgagcctctaaaactatggctgtggcatcacattagatgctgtgagatggctggaaacacaggtaagaaaatagcgtaatttcctataaatctgcactcagaaaaaagatggctggacatggttcttctgacagcccaccgcgcatgtttttattttgtcaacgtaagcagatggcccctgggcccttcctctgagagtgaaggatggccgtgctgaggacccttctatccctcatccttcaacacccctgccacatcaccccacagggagcctgtgcctatggggtggggacctttccagaggcgtctgcgtgctagaatttcaagtcaggggcctgtgagggacattggcgcccttaaagattgtccctgagagctgacctctctgcctcatctaccactgatctaaatacctgcagggacctgtt

SEQ ID NO: 48363 - DNA, 365 bp, Homo sapiens
ttattttatttttgcttagctttgcttcaggggactgaaggtgagggatcagttcttcatagtggaacaccttacatctttctctgccatctttgacgtttatgaggcatatttttctactttgtttggtagctgttgctgaatttgtttcattggtgctttgctcactttacttacttttttagctattgaagaagaatgactgtatcatgctgctgatttccccgtcttggctagacagtatgtcatcctttatctacattggtccctgtagtgaggatcatggagtagatgttgctgggagagtgagtatatgtgaaaaaaatgtgaaggtatttggtgctgatgaagcaatatgccctact

SEQ ID NO: 48364 - DNA, 349 bp, Homo sapiens
aaatttgtgtgtgccaaatgtcgtcctattattagactcaggttcgtggaacaccttacatctttctctgccatctttgacgtttatgaggcatatttttctactttgtttggtagctgttgctgaatttgtttcattggtgctttgctcactttacttacttttttagctattgaagaagaatgactgtatcatgctgctgatttccccgtcttggctagacagtatgtcatcctttatctacattggtccctgtagtgaggatcatggagtagatgttgctgggagagtgagtatatgtgaaaaaaatgtgaaggtatttggtgctgatgaagcaatatgccctact

SEQ ID NO: 48365 - DNA, 381 bp, Homo sapiens
ggcaacaaaaacaaactttaaggcaaaagtgtggtgggagtgaggaaaggcatatggttgattaaaacaactttcctttttttccaccaaaacatttaattggctttagagtcaaggaaggttcatagtcaaagatgccagtaagttcctttgtatcccacttttcatctctgctttgctcctattttgtgtcaaggtttatgtaagtgctaaagggtttagaccaatgatcctcaatttgaggtgattttgtacccccaccccaggagacttctggcaatttctggagacatttttggttgtcacaatttaggggtggggtgctactggcatctagtaggtagaagccagggatgctgctaagcaccttgcaaggcacag

SEQ ID NO: 48366 - DNA, 223 bp, Homo sapiens
tttttagtaagttatatgattcatttgtgtatcatatatggaattaacatatgccagaatgaaaaaaaaaagagagattatctgtgcttggaaagaacaagagagagggaattacaaggaataaataagggttcatgcctaaaataccgttgtcctcccttccactcagatttaccttttgcattgtcaagggacagagacataaatctctttgactagataa

SEQ ID NO: 48367 - DNA, 626 bp, Homo sapiens
agactagtctgagcaacatgatgaaaccctgtttatacaaaaaaatacgaaaattagctgggcatggtggcgtgcatctgtagtcccagctacttgggaggctgaggtggagaatcacctaagcctggggaggtggaggttgcagtgagctacaattgcaccactgcactccagcctgcgcaacagagtgagacccactctccaaaaaaaaaaaaaaatttttttcaaagtaaaaaaagtaatctaatagaggaaaatgctccagtcagagtggcttggaatctgttttagttcataaaactaggggctgaggtgagaaaaagaggctgaaacaagctgctgccctctgctgcctgggacagcagcttttgtaactctcatacccaggaaccaggccaacatagacatggccacaaaaccaggatctgtgccaaacatacagggccatgactgaattcacaaaaaccctagataaggatggtgagagcagtgagaaagaaggttatagcaaaacaaaacagaacgaaattgcaaaacttcccactctaagatgaacctgcaaataaatttcctcaacttattaaaattaattgtagacaggacaaattccccaacaccaacaccaa

SEQ ID NO: 48368 - DNA, 448 bp, Homo sapiens
tcatgccttctgccagccttcttggtaccatgggagaggtatagctcctcctaactaaggctactctttcccctgtgttttatttatttattttatttttattttattttattttactgagacagggtcttgctttgtctcccaggctggagtgcagtgatgtgatctcggctcactgcaacctccgcctcccgggttcaagtgattctcgtgcttcagcctcccgagtagctgggattacaggcacacagcaccatgcccagctaatttttgtggttttagtagagatagggtttcaccacgttggccaggctggtgtcaaactcctgacctcaagtgatctgcccacctcagcctcccaaagtgctgggattacaggtgtgagccacctcacccagcctcccctgtgttttagatcccaccctcataccctttattctccttgaaa

SEQ ID NO: 48369 - DNA, 429 bp, Homo sapiens
gccaaggactaaattgcggattaagagtttcttccttttatttcctgcatatccagaaacctggggtcatagatactcttccatggtgtgttgtttggcacaacttgcaagtattttggcagatggttagaaaaaaagactttaagaaatatgcaatagtactcaggactctaaatataataaataaagctaagataccagtatcctgccattcattacaatcaacatttattgaacagcagttatatgccaggtagcagggatacctagaacttgcccctcccactagcactccagaagagttcctgctttcccagcctaaagcaacagcaagtcttacatgagctaggcttactgtgatagctgtcctgacggcgagtggcaaacatggcccagtgccttcctcatggatgaacatgactctacact

SEQ ID NO: 48370 - DNA, 389 bp, Homo sapiens
aattttgccccttagcccatagaacctaaaatatttaccctctggccatttacagaaaaagtttactgattcttattcagaaagtaaaatctaagtaagaagttagtggaagagaaggaagattttcagcttgggcacaggagaaagaaccaatggggtatgtaaaaaataagcaatcattccataccaaatcatatttttaaaccatattttggccaggcacagtagctcacatctgtaatcccaacactgggattacaggcatgagccaccgcgcccggcccacactcagctaatttttgtatccctctatccatccatcagtctattatggggtttttttttgtttgtttgtttgctttttttttgacacagggtctggctctgtc

SEQ ID NO: 48371 - DNA, 354 bp, Homo sapiens
actatgaggattctcacatggtgattttgtaattctatcattcctccttcatttgttactattgtactgtaaggaaaagctttctcatcttcatctgttcattcatgtatttattcagatgagtgttattttattggttttaatctgtcacaaacattgatttgatgctcaaattatatccctcagattggctcttcaggctgacttcagtgtcctttctaaaacctttttatttttaaatgattttaaatttatataaaagctgcaaaagtacacaagtgcttatatacccttgcatacccagattcttagaacttttgagaataagttgtagacatgtgccatattatactt

SEQ ID NO: 48372 - DNA, 354 bp, Homo sapiens
tcccataggggtttatatttccctagtgactttgaggcttatcaactctgcatagacaactgctttactttgtggcacgatgccttagttccctttgtgattcagctggagctgctaatgctacccctttatcatgttgctgggccagatgggcctagctccagatgtcagctccaggatattgctgttttctggctgacagtttctacatagccacttctgttcattatgaattggagctgggcgtggtgacacgtgcttgttgtcccagctactcagaaggctaaggcaggaggactatttgagcccaggagtttcagtcctgcctgggcacacagcaagaccccatctctt

SEQ ID NO: 48373 - DNA, 499 bp, Homo sapiens
cttatgcaggcaaaaacaaagccaaagttagaaagtgcctatgtgtaggattctctggagggtccaccagtggatggtctttaggattgaagaatcctttaaggctgctgtgaaaagggtcctcagaggttacccaagccagtttcccttttggccgaatggggagagagacacacagagaggggaggggtgtgtgctggatgacacagctcctcagcggcaggaactaggatttaatccctggcatctgacttccaggccttgccccctgcaccgctgagagaatgtgtctcataaacaccatcacctctcaccccacacggacccaccacccacacacagccttcagccttcatgcatagcaatttgggctccctttcaagtcaggggatgaggggttgtttctgacacatccctttgcttttgtaccacaccaggcaggaggaaccagacccctgttcctcatccccaactgcccccccaacacccctccagtttg

SEQ ID NO: 48374 - DNA, 575 bp, Homo sapiens
aaataaatgtggcaggaggtggggcgttgggaatggggaggcacggtggttgtgggcaaagagtcagaaggagcagacagacccggaagaaaaggaatctgctctggaataacacttttttttttgaggcctcaggccttgggcaaaattgcttcgctctgtaatgatttctgctgccggagttgctcctccacccctaagttaaagctatgaacctgggtgcccgggcaacgccccacagtggatagcagccgggagcgctggttttgtgccttttgtgggggcccttggttccccctcattggaggctgactctgaaatttactggatcagtaaatttcctggctccctgggagcagctgttaacgaggataaagtctctgggcatgtttctggccctgcaaaaggacctcacccatgaaggtacaattctcactttgtttagataccagaggggcacccacaggctggctgagaatgaggcatagttgattaaaaaaaaaatcagtcattacaaaattgtttttaaactcacacgtgcttttaaagtgttgtggtttaaattactttaagat

SEQ ID NO: 48375 - DNA, 572 bp, Homo sapiens
tcacaagcctcatggtcagcaagcacaattgccatacttcttttaggggagagatgagatgcaaaattctgatttcaaaactctgtatttgcaaagtctgaatgatacctattgatatttgtcaagaaattaatttctaaaatgctgagaattatagttgaaatattcctttttgggatgtcagaacctaggttgtagttatttttaaaactgctgttgttgttattttattttcccccagaatttaggggccatttggataattcaaaactgcctttcctattgtattcacagaaaacagatcctctagtccctcccctacttctactcaggataattgtcgaacagtgctgggcagtgaaaaataatgagccagggacaccccatcttctaccaatccaaggttaaattagaaaagatcagccctagtcttaacaaaatatccctttcgaatgagaaatcattgctatctaccttatgcccttagctggacctgaatattctccctattgctcactactccaaaagccacaaatacttaataaacagtaactgtcagcaagcaatgtcat

SEQ ID NO: 48376 - DNA, 508 bp, Homo sapiens
acaaagaattaagatgtgctataaatggaaaaaacaagattaaggacttagcaacataaaatgtaaaatacctcaattttttttattataaattgaaataataggttttggaaacaccaggtaaattaaaatatatttaagtttaattttactgttgctttgtacttttttctttttaaagagacagggtctctccctcgtcacccaggctggagtgcaatggtgcaagcatagctcacggcagccttggaactcctggcctcaagcagtccacctgccttgccctcccaaaatgctgggattataggcgtaagccacccactccaggcctctttttacttttttaaaaatgtggctcctagaaaaatttaaattacataagtggcttacatttctattggcagtgctgttccagacaacgctcttaacattaaaggcataaatgcaaaaattatgggccaaatctcaggcctcctggagtttgtattttgctgggcacagaagaatc

SEQ ID NO: 48377 - DNA, 467 bp, Homo sapiens
acgaggagactgaaggtcatgaattctacgaaacttgttaaaggttgcacatctagtgaatggtgggatggagaacaagactgaggtctaagaccaaagatattttctcctctctagtcctctaatccgtcctcagaaatagtctttctatcctggcttctacgcccttcccaggctcatttaaccaacctcccctttgccctctccctcattctctgcataacttccatggcttacccgcaaagccagatgagaccagccccaagatttatgttaaacatttatgttatttgtatcaaaaattaattatggatctattaattcataacttcataaaattataactcatggcaaacatttgaataggattactaatgtcatgatattttgtatttaaatatcttgctttataaagtatgatgactaggtcatgctttcagaacagacttaaggtaattctaatactt

SEQ ID NO: 48378 - DNA, 288 bp, Homo sapiens
tgttgcctctgcctcccagggtcaagcaattctcctgcctcagcctcccaagtagctgggattataggcatgcaccaccacatctggctaatttttgtatttttagtagagacaggctttcaccatgttggccaggctagtctcgaactcctgacctcagatgatccgcctgactcaacctcccaaagtactgggattccaggcatgagccaccacacccagacttcattttaggtagtttctattatgaacttctagtccgttgctcttttcttcttgtgatgtctg

SEQ ID NO: 48379 - DNA, 3129 bp, Homo sapiens
  misc_feature (1236)..(1236): n is a, c, g, or t
actaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaancagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaa

SEQ ID NO: 48380 - DNA, 3644 bp, Homo sapiens
  misc_feature (1236)..(1236): n is a, c, g, or t
actaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaancagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaaaaaaaaaaaaaaaaaaaaaaaaaaaaaaaaaaaaaaaaaaaaaaaaaaaaagggggccggcccccacacaaaagactccccaccgaggaggcgcccaccaaccaacccagctacccacgtcatcgtgacacaaagaggcgcccccaacaaggcagcgcgcaacctaaagagacagaacaggcaccgactacatcacacacacccctgaccactagaggccaaacagcagcaccgaccacaaccaagcaagagaagacccacaccactcgcggggggccgccccacctcgcggccgacacccaccccgcccccaccgagaaccctaaccacgcagcccggcgaacaccaacaaccccaaacgcgcgcctctccggtccccaccccccccgcaccacaccaccgcccccccacaccccccgcccccccagagcgcccgatctcacaacacacacacacccgccgcagcagaacaaaataaccacaccccacccacacagcacgccacacgaccaccg

SEQ ID NO: 48381 - DNA, 1148 bp, Homo sapiens
ttcttgaagtccttggatttctctttctcaaaccgtatcacttcttttcggaccactgttgaaatcctctcgaagtccctttcatattgagacactcctttactcacagcagcaggctggggagcagttgggaatcaggtctggaatactcctaaccaagaagttgcccagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaa

SEQ ID NO: 48382 - DNA, 2864 bp, Homo sapiens
  misc_feature (1236)..(1236): n is a, c, g, or t
actaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaancagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcactgtttggacttgggcactgtttggactttgggcactgtttggactttgggcactgtttggactttgagcactgtttggactctgggcactgtttggactctgggcactgtttggactttgagcactgtttggactctgagcactgtttggactctg

SEQ ID NO: 48383 - DNA, 666 bp, Homo sapiens
  misc_feature (52)..(52): n is a, c, g, or t
tattttttccagatctctcactgcaccctcccagattattcccctggggagncgacactgcagcaagacccaagatgtgtcggaagagcctgctgggacaaaggcaggcagacaccaactgtattcatgctcatcttatgcctcttccctctgctgctcctatcagaagcataaggcactggcccaaacagaaaaatgcgaccttacacctaggcttgacaattttcaaactgtaagcatgactctgtgaggctcccagcaaccaaagggaccaggacaagggactcccacaggacagatgggcatgcagagctcaggaaggattgtgacttgctacaagtcacctgcagcttccatgccagtgtttttcccacccctgcatgtggccttgtccagtggagaagaacatctccttgtctcttccacttccactactccttcagtacatcatgggaagtcttgtgaaagaaagcaatattgaaactgttttcctggctgggatgagtaagaatctggagtgtgttactgtaaagccatctctcgttcatcttctcatttaattaaaaaaatttaaaacccagtgctcacccaggtccagctatgggctcccaggtagcaggggagagatatgctctgaattagcaatgcagggctggacctgccaac

SEQ ID NO: 48384 - DNA, 744 bp, Homo sapiens
ccgcccaggaggtacttctgaaacaggtccccagtggcacctcagtttatccattcccgttttggtttcgcagctgtcatccggtcccaacgccagaataggagaaaaacctgcaggctaagagagaagggagggctgggcctgaggttcagtcttggtcatctccgactggcggcgctaggatttcccccttcctgtgtcttgatgggttcctccaacactcactttgtatcgataaacgaccctgcagttcttcacgacctgcattgcgctggcagtcctgagtgaagaactctcctctcatcccagagatgggaaacctggatctgagactgccagctagctgcggcctcctagtctgtaaagcgaagggagaccaggacgctcccaaggacccggcttatcgcccctccctttccttcccggggacccagaacagaccacaagacggagggtggccgctggaggtcgccgtggccccgcgataccaccaaccgacagaaatggagaacagttgattcagattcagctgatattctcaggtctggagcgggcctgagcgctttaattagcccggggctaatgtcctcacccatctttgtttatagaacgttgaaactccagtactgttggtaagttccaggaagacaggaactttgcactacttgaactccagggtctagaacagcctgcaatctagcagatgctgtaaattttttaattaaatactgaactcctgtaaaa

SEQ ID NO: 48385 - DNA, 262 bp, Homo sapiens
tatcctttagaacagagaaaccagggaggactcagaaaagtctgaggtctccatctaattctcccatcttatgacccttttactatttccttccttccctacagcaatttgtctgtagggttttaaatgtatattggccggccatagtggctcatgcctataatcccagcactctgggaggctgaggcaggtggatcacttgaggccaggagtttgaaatcagcctgggcaacatgatgaaaccccatctctactaaaaata

SEQ ID NO: 48386 - DNA, 414 bp, Homo sapiens
aacgcctactgtttgcagaccctgtgtgaagcgctgagaaatggaatgaggaaggagtcccagcctcggcactcagggacttcccatgctctcagtgagatagacccaaatcattgcagtgcaggtgccagtacatgggttagaagtggcagaagagggcccagcagacacctgggcctgaatgctacgtgacacctgcgtgacacctgggcctgaatgttgtgctaagggctcctttcttgtaccttctctgtgcagaggaacagtctgtaaagaacacctccccaggcacggtggctcacccctgtattcccagcaatttgggaggctgaggccagaggatcatgtgcagccaggagttcgagaccagcctcagcaacatagcgagatcccatctcttaaaaaaaattacca

SEQ ID NO: 48387 - DNA, 361 bp, Homo sapiens
cctgtcttacaaaaaaaaaaaaaattatccaggcatggtggcacatgcctgtagtaccagctacttgggaggctgaagtgggaggatcgtttgaacctggaaggttgaggctgcagtgagctaaaaatcacaccagagcactctagcttgggtagcagagtgagacccagtctcaataaaaataagataaaacaaaataaaataaaataaatcattggctttttgggaggattaatattgattacacctgggtaaagtatagcacatagtaaatgcttaaaacatggcagattagagaatacagggtggataagagaagtgcttaggaggtagaattgatttgattgatttagaattgatt

SEQ ID NO: 48388 - DNA, 405 bp, Homo sapiens
catctcacccagcctcttccttgtactaaacatagacaatagtatttcacaccagggcctgccctctaccttgacgtctctgtgaggaggcaggggaggaatgctcagagcaccttctacctgccatcctccaccctttcagtcaggaccctgaatggacagagagaggggcatcaaggccttgtcccctgtgagcccaagaaggcaggtaggttaatccaacatccccctccaggtgactttcctcctgtccctgacaagaggactgttaacgttgacccaagagccagagccctgccctgtggcctcgtgtgctcagcctctgcaggggctcttaccatgttctggaagcatcctgatgggggtcggggggctaggacctgcaaagagcacacgaggtcgacg

SEQ ID NO: 48389 - DNA, 221 bp, Homo sapiens
ccagctctttcccgctccctttcaaatactgtttttggatccctccactctattgccatttttactggtaccccattgtctaataagcagctatctttagcttcttaagtctctgtagccttgagtctttaagagctaccatttactactaaaggtcttttccaaataaggcaaaataacaaagtgtccaatctccaatgatagaaatcatgaaataatta

SEQ ID NO: 48390 - DNA, 398 bp, Homo sapiens
tgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgc

SEQ ID NO: 48391 - DNA, 706 bp, Homo sapiens
gacagaagagctgcaagaggacaaataacttactttgttgttcccctatgcatgtagccgcaaggaaaagaaagagaaatatgttaaacagaaatttattttaaaattatgagggttttttcttctactttctctggatattaaaaaaaataaaatgatgaggtttttcttgctagagtgaaatcaaaacaaatgatttaactattcactgacatctcatacatacacatacagcatccagagctcatggacaagtcaaagaatccacataggttacatgaaatcatacatttataacagcagaaacttagaacagttgccccctttctttctatttggaatacctggggtatgggaacgtggccagaaagaattggtttgaatcagtaataagtgaactgttagcgtgaaaggcagagcattttgtgtgccggcttgccctttcctgacagctcctcctccaacatgccaagcagtggaaaatttcatcagccagtgcatttttaaacaaacactgcatccttggtttcaaagaaggtggaaaaaaaaaaaaagaaggaaaagagagcagaggaaaggagtgggtggttctagggagacagggtaagcagaccaagttacgacctccatctggaccattcctttattttgtaaattatgagttttgccttaggttggcatgggaagcaaggactgtatagtgggg

SEQ ID NO: 48392 - DNA, 735 bp, Homo sapiens
gattaattagagacaagttttgatataaaaaatgggttctctcaggtcaagaagttacctatattcgtatcacttggtgaccacctacacttcatggccagaaaagcttagtgccatttggtcttgggaagacctgagactggtgctcaaaccagaagtctcagcagggcacagtggctcacacctgtaatctcaacactttgggaggctgaggcaggaggattgcatgagaccaggagttcaagactagtcttggcaacatagtgagaccccaaacctagcaaaaaaaagactgctgggcatggtggtgtgcaactgcagtcccagctactggggaggctgaggcaggaggatcacttgagcccagtaaatgaggttggagtgagctgtgattatgccaccgtaccccagcctgggtgacagagtgagaccctgtccttaaaaaaaggaaaaagaaaaagaaaaaaaaaatacctggatgtctctaggaaagaaaattgtaataatccttctagtcaagaagctttctcctcaaactaacagatctgtagtaaaggaataagtttaatgatatcatcagggaaagtatgaccactacaactaaaaagccctagtatggaaataaccaaatagaacaaagtgaaggagcccagcaggggtctgcagaacacagctgaatagcaagaaaggaaaatatttccttttaactctcttgttggccagataaaaaaaaaa

SEQ ID NO: 48393 - DNA, 528 bp, Homo sapiens
aaaattagacataatctatttttgccaccttgaatcctacatattacctacataagttattgcaggactgggagaattaaattatttgctgtatttatagtactcataatcgaatatagtatatgctatataagtgtcagcaaatcttttttttattcttgttcatgctgttttttttcctttctccttcttcattagagtgttattgtatttttgtacctgacaaacttgtattcattcttcaaaatgcatagtgtagaacacatggacacagggaggagaacatcacacacaaggcctgtcggggggtcgagggaaaggggagggagagcattaggacaaatacctaatgcatgcagggcttaaaacctaaatgacaggttgataggtgcaatgaaccaccatggcacatgtatacctatgtaacaagcctgcacgttcagcacatgtaacccaggacttgaagtaaaatttaaaaaaaagaaaaagcagagtgtaaggaaatagtctttggcatttgatgcatgc

SEQ ID NO: 48394 - DNA, 387 bp, Homo sapiens
aacaaattgtcttcctcacattttagaagcttataactaaagtgctagatgctggctttgctgatgttagcctgaactacttaaacttaacctgattttctgttttaaattccttagccctgattattcctttcctatcaaacatttgggcctgttagcctgaactacttaaacttaacctgattttctgttttaaattccttagccctgattattcctttcctatcaaacatttgggcctgttgagtcctccaaaatggggtcatcagaccagatcctgtgagcccaatctagccccacctgcgggaacacagcctcacacattcgtttacctggttttggctgcttgtgtgcttcagcagcaaaggagaatggttgggacagaga

SEQ ID NO: 48395 - DNA, 265 bp, Homo sapiens
aaatcagacactagtgcaggaaagaagtgaagctggccaggaggtggcagcaacagttcagcccaaggcaagtgctgctgggcagaatgaaggtccagcgtggccaagtcttcctgatctttcaggggcaaaggaaatctggatttttaatatgtggggtgttaaaatatacatatattatcatatataaaacatacatatatacatgtttctgcacagttcctggcttataactcctctagcccttgttacagtcttttaggtg

SEQ ID NO: 48396 - DNA, 205 bp, Homo sapiens
ggtaagcatgtttatttcaaaatactaaaataatttttttgaagtttcttaagttcaaaatttttatttttgtatatgtttttgaaaagaatatgttcaaaactcagaaatgaaagaacagacgcctcctagtcgccccatctcccaacttccccaatagaggtgacaagtgttagccttttgtttttgtgtgtgtgtgaccagt

SEQ ID NO: 48397 - DNA, 455 bp, Homo sapiens
taagtcatgtggggaagtggccagggtagggcatggtcatcgtgagcagggtcctgcagggtgaggccggggctgcagacgcgactgtacaggtctatgaagaccccatgtgtgatgaggagaccttctctgcacagtccctggacagaacacgagatgaggggtcctctggacgtcagctccagccacacccctacctggaggaagctgcttttaacagagcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagc

SEQ ID NO: 48398 - DNA, 322 bp, Homo sapiens
tgtcccagcctggtccccacccaccaccaccactgacccgatgctagagaaggatgcggctggaggtgacttcccagccaacttggtagcctccaactaatgccactgaagacattcccagctgctatccggggagtcatccagagtgagctcaactattctgtgatcctgcagtgggtggtgacaatggaccctgagcctgtgctgagctggaccttcagtggggtgccctgtgggatgggagagaagctgttcatccgacggttgtcctgtgagcagctgggcacctacatgtgcatagccacaaacagcaagaaacagc

SEQ ID NO: 48399 - DNA, 430 bp, Homo sapiens
gattcagtaaatgtgacattgataaaatactttgatagaatactagcagtatattacatcaattgagccaattctttatagcatgattttcctccagcatggagtccaacctagaatcatgtattgcaattagttgtcatatctcttcagtccccttcaatctggaaaacctctccagcttttcttgcctttcacgacaataccattttttaaagataaaattccccctgtttttaataggaatgttcttgtttttggtttgtcttatgttctactgggttttttaaattttttttttcatacttttccaataacttttttgttattttttataggcattcattttttggatttaggtacaacacatactgttttctcactccaacattggggtatgtgtaatatttccctgttctttgattatagacat

SEQ ID NO: 48400 - DNA, 295 bp, Homo sapiens
ccattatcacagtgagtagtagcatccaaaggttaggtaatgccccttttcctagccgaaagactgaagaccgaattctcctaagattgttgggcttaccttaaattcttctattaaaatggaaaatgcccaaaccccagtctgtctgtccttagagccaggaaaaaggactctgagacgtacatgctgttggcatcagttaaatttcatgttcctagaggtcctacaatcctgtatgtaaagctacagtgagtaattgcaactgcattataattattttggtaatgactccctt

SEQ ID NO: 48401 - DNA, 544 bp, Homo sapiens
atgccatggtagggactttggaatttaattcaggtgatgtgggagtccctgccagatggatggagggtgaaataatgcttaagccctcagccttactccatctgccttgttcaggagtgactcctaggaggaggtggcaggaactggcacctctgatcctcagctctaaaagggtctgatgctttcacacctcaagagatttgcacaggccgttcccctgcctgggagcaccctcccatggctccttctggagaagtgtgccagctcattctgtaatcagaggaacgatgctttgctgagcactgtctacatgccactttgtatgtataaccccctcgattttaatttttaattttttttattatttatgtatttatttatttatttttgagacaggctctcactgtcgcccaggctggagtgcagtggtgcgatctcggctcactgtagccttcacctcccaggttcaagcgattctcatgcctcagcctcccaaggagcggggattacaggcacgcactactatgcccagcaatttttgtat

SEQ ID NO: 48402 - DNA, 474 bp, Homo sapiens
acccctggtcagttaaatcacagtctctggaaaatggagtccaagcttcaggttgtttgattttgaaaaggctcccctggtgattctgatgcgaagtctacacaggctctggccttttcctcctcctctgaacttatcacccacaactctatccttctccgtttctgttccagccacaacaatttccttactcttccttaaacatggcaagcatccacataagatgttcctgagagaaacactgctgaaacaagaaaaagcagtgacagcaagatgattcttgccatcatactgatgcgttttagttgaattttaaaacatatacaatgttaaaaaaaaatcagctttgaaatgtatgcctttttgtcttgatttaaaagcagtatgctatttttcctagttttatatgtgacagtctatgcttagtcattgtttaacaaaagatccaggtactagactttcttcaatatgtta

SEQ ID NO: 48403 - DNA, 529 bp, Homo sapiens
acttgaatgatatggcaaaattagaaatgcaattttagaagtaattacactgttgtgtaaatggccacctcttttgaagtctttgctacattgcttataaaacactgagttgaacatgagaaagccttttgtctgcagctgtacttttcaactggacatgaaccatgtacttttatggcacgtagatattcacatcaaatttctgatttgcagaccgattttatttttagttaacaaataagcttatcaaatgtggcttttgaactaaagcgcttttaattaaggagttataacagcatgttattttgagtagctgttactaaaatctgttgtgatggaacaatttggagtgagcatctgatatcagagataaagagagaagcatgcagtgagcatctggaagttcttgtaaaaaaaaaaacaaattaaacattctcatttgaatgcatttaaaatttttttaaattgccaattcctaagctttttctttgttagttgtagtttgctttctcgactgtataaaagaaaa

SEQ ID NO: 48404 - DNA, 297 bp, Homo sapiens
tgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattg

SEQ ID NO: 48405 - DNA, 244 bp, Homo sapiens
tgagacagagtctcgctctgccgcccaggctggagtgcagtgtcgccatctcagctcaatagtgaccacctaattttctaagcagttggtcacttttccatttttatgtaacttgacctcactgtagcatatgactttgctgttcattcactcgtttgaagctctgtcagagttgtgatctgtcatgattgtgcccagcaaaaggctggagtcgacctgagagcctcaaatagttagcacccat

SEQ ID NO: 48406 - DNA, 874 bp, Homo sapiens
agatttgccaaagaaatagaattgcagttcagtagttgagagggaggttttgctgggctctgatattttcagaggcaaatgcttttctttgtgcttgtatcaggtcatcaatgaagggagattaaaatgatcacatttttctcttagtgtcagatagcagttatttagtagacaaggattagactccaagttgtatcacagaccaggtatttgctatttttctttttagtattcttttaggcatctgataaatttttttatatgtaagtttgtctttcttgggctgtttccctttcctccccctgtctagtagctgatattttttcacgttcacagttgcaggcctccatttagttcatccattccgctgcacattattctcttccggggaccagcttccttggtgacttcttcccttgaagcccttattcctgtcagtcttacttagtcaagtttttgtctctttgtctcatcaccactggtgtgcttcatagacctagccgcccctctagcctaactgtagacaaggttggtgacggcagcggagatgacaatgatggtgttggtggtgggaataaatgcagtgctataattatatcatttccagagagatcgcatttctgactatgagccctagagtcaggctgcttagcttcaatgccagctctttcatttcttatttctgtgaccccaggcaaattgccttacctctcctagacaaggtctttcctcatcaatgaaacaggaatgaaaataatagtatttaccacatcataggattgttaggagatttaaatgaattaacacatgtcatataataatagcttaaaaacgttattttttatttttaaatttttgcactgccccttgcctg

SEQ ID NO: 48407 - DNA, 571 bp, Homo sapiens
agattttattcgcactgagtttggaactgtattttctcacagaagtcaagtcaaaagaacaatattataatggacttaaggaaaaacggttgagaagaataggaggcataaagggaaaagaaaggagtaagctaatttaaaggtttttggatactattcataacccattaataataataaaaggataatgacttcttcttgtggttataggaagacaggaaatactgatatttaagtggtcaactccctttagtaagaagtacagctttattttgatgtcaagttttcaaaaattttataaattaactcacttattcacccactcaatctatattgaggggctactatgtgttggttattgtgctaggtaatggggatatagggatgagcaaaataaaaaagattgctgtcttcatgaagtaattctagtgggataggaagataataaaacatgtaagtaaattaacaagataactatatattgtgataactattttgaataaataagatgttaccactttaaggaggtaacatcagaattcagatggaaaatgtaagcatatttttcttg

SEQ ID NO: 48408 - DNA, 1046 bp, Homo sapiens
caactgaactgcttgctccagagctattgacctcttgcccagcctcccagcttcctgaatccgtgagaacattcagtgaatcaatgaggacatccacatcctcattgagttctcctttgcccttcccgttccctgcctcagtcacaagaccctctccacatctctcaccctgtcttgccttgacgacctgtccaggcccatcatccacctgacctataaacttcaaacactttctggtgtttcctgcttccaaatattcctcaaaattgaggatcctgagttgaatatctggagttctcctttctgatttctataatggtcaacatgctctaaggcagattttccaagcatttctggacttgccagagacttcctcccttggcaggtctgaatcagaaaattcacacgctggctgggcacggtggctcatgccttggcctcccagggtgttgggattacaggtgtgagccactgagcccagccagaatctctacttttaacacatatcctggagaattcttatgatcaagtatgttggaggaatagctagaatgcctactggggtgataacagttttaaaaagtattatgttttacttcttcatgtatatttgcatgttttcctaacagaccctcaacgttgctagatgattggctatatggatgatttgactgggaggtagtggccctaatggagtaataagaaacgctgtgcatagatggttgagaaacagccctgggtgctgacacatcccaaacattaaataggccttatgaaatgtattttggtgttcttgagatacgaggatgaattttcaagaggacaatttagtctcattttaacttggaagatagaagagatggtcaagagtcttatccgttgtttatataaaaagactgtagaaaatgcgtcaaagcattcgtgagattaggcacctctacatgcttcttgaggttagacacctctacatgtttggtgtggtatctagcacagagtaagctctaaatacaacaaatagaatgaataaataaatgaatgaatgaacg

SEQ ID NO: 48409 - DNA, 672 bp, Homo sapiens
attatagatcagtttgcattttccagaattttatataaatggaatcatatgtactcatactgttttgtctggcatcttttactcagcaaagctattttaagattagccttgttattgcatttgtcaataattcattcctttttattgccaagtagtattcaattgtatagacatcacatttttaaaaatccattcactgttgatggacattttgggatattacaaataaagctgctgtggatattcatgaacaagtctttgtgtagacatacgcttttattttccttggataagtaggagtgatagttgaatcctgtgttaggtgtatgttgacctttttaagaacctgcctgttttccaaagtggttgtaccattttacattccccaccagtagtgtatgagagctgtcctcttcaaattgactggagaagctttgcttccatctcttcttcttggctaatagaaggtgcctcttggctgggcgtggtagctcacgcctgtaatcccaacactttgggaggcctaggcgggtggatcacctgaggtcaagagttcgaaaccagcctggccaacatgacaaaaccctgtctctactaaaaatacaaaaattagccgggcgcagtggtgggcgcctgtaatcccagctactagggaggctgaggcaggagaat

SEQ ID NO: 48410 - DNA, 490 bp, Homo sapiens
taagtgtaggggtatatgacttaacccttacctggcatggccttgggtcttgtttatcttttgatacctttttgccacaaaaagtcctttctgtcagtcttgatatctcttctttaacatcaatgctggtcggttgttgtgtctaaacttcaaaagggagggagtttaatgaggcatgtctgccctcctgtcctgttatgatcaggaactctgttttaaaggtttttctggggtcaccttggccatgagggtacgttcatgcagttggcagagggctcaggattttatttattttacatcactgactgaatgactttgaaattcatttttgctagtttgctaattttgatcatttgatgatgcatcctaataaagtcaacataaattacaaagcaaaacagtactgacatgcaaaacttactgtgatgaagtcattttgacaactaacattatttgagtcacaagttaaaacaaaaagcaagctctctat

SEQ ID NO: 48411 - DNA, 549 bp, Homo sapiens
tgacattgaagctttgtcctgcttgaaagcccatgaacgtcttcagctcccggcaaaagacgtgcgcctgtcaccaccctgggctcgccagcagaacctgatgacggggtcactcctgcctgcccctccctgggctgggtctgcccaccagggtcagtgtgggcttacagggctgaacctaacgtacccccgtgggccccctgtatgtcatatttttctctccccaggcccgaggccaacaatggtgcccccgctagccacagtgacctgccaactttactggtactaggcgcagagacacttcttaccacccttcctggcattcagaggtttggggcttgaaggagaaggagaggctgggtgagcctgtgaatcactgtagggaggaatggcaggcacctccacaagcaacagtcagatatgtctttgtttcagctgggtgcagtggctcacgcttgtaatcccagcactttgggaggcttaggcgggcagatcacaagcccatgagttcgagaccagcgtgggcaacgtggcaaaaccctgtctcta

SEQ ID NO: 48412 - DNA, 803 bp, Homo sapiens
caagaaggcccccaaaaggagccagcatcttgattttggacttcccagcctctagcacgatggagtcttgctctgtcccccaggctggagtgcagtggcatgatctcggctcactgcaagctccgcctcctgggttcatgccattctcctgcctcagtctcacgagtaactgggattacagtcatatgagaaaacggtctgaactttgatcttcattgggattcagatatcagagagtggcgctgaaggaggaacaattttaattagggacaaagaaggcctagaaagaggtttattctcaagtgaggagcacctctgcccagccgccccaccatctgggaagtgtggagcgcctctgcctggagcccagctgtctggaaagtgaggagctcctctgcccggtcgccaacctgtctgggaagtgaggagcgactctccttggtcgccacaatgtctgggaagtgaggagtgtctctgcctggccgctccattgtctgggaagcgaggagcgcctctgcctggccgccccactgtctgggaagcgaggagcgcctctgcctggccgccccactgtctgggaagtgaggagcgcctctgcctgatcgccccaccatcggggaagtgaaaagcccctccccctggcccgcgcctcccgccagccgcagcaccatctgagaagtgaggagagcctttgcccggctgctgtgcaaccctccaagtgtgaagtggcagccctgtgtgtgatctttctgccctccccaagtttgcattttcaatattaaagtttacttttaaattagaag

SEQ ID NO: 48413 - DNA, 592 bp, Homo sapiens
gaaggcaagttttcctgcttccatgacgatggagagcaggcatctcctttcctgagtttcagcttgcttctgacagggaaggtgagtgtgagttttttccagcttctaagatggcagagaacgatcaccagcctgagccttatttccaggtaagtagctgaattagagttttgtcttaaaatttttccttaatgattaaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatgttccaaattgtggggagcaaggcatctgaaatggctaaaactcctgtggctgccaaaaataaaaataaaaaaaaaatataaaaaaataaacacacacaaaaaatgaaaaacaaaaacaaaaaacacaaaaaagccaaaagaaaaaaccccaaaaaaaacaaaaaaaggcaaaacaacaacaacaacaacaacaacaacaacaaaaaaccca

SEQ ID NO: 48414 - DNA, 2638 bp, Homo sapiens
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgggaaatgggcatacagtactgagaaatgggagcacacagtactgggaaatgggagcccacagtactgggaaatgggagttcacagtactgggaaaggggagttcacagtactcggaaatgggagcataggtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaatgggctg

SEQ ID NO: 48415 - DNA, 3495 bp, Homo sapiens
  misc_feature (1901)..(1901): n is a, c, g, or t
  misc_feature (2233)..(2233): n is a, c, g, or t
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacggggccacctcaccacacttccccaggatttcagggaacaggctcctgtgacttggaaataaaaagggatcagcccagcctggaggaacagcgacgctggtgtccaagccttgccccttgcctgcacttccagcaaagatttggagacacactcggtggaaatcgattgagcccccagcccaccctggcccagactcagccaccaaagttccctcactgcatgtggcacacgggctcatgggagtttctctgcctgtgtttgtccacgttgacaccttctgcacaggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcncgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggtgctgggcaccacaggcctgcagcttcttaggctctgggaggaggcgcagtggaaattgaggtcgccgtgaggtcgctccaatgtngccgtacactgttgctgcctggctaccttcccatctctgtcatcatggagagtgtgggcaggggacccctggccctcttccttcttctcctgccccggggggagcagcagagagccaaggggctggaggaggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcccacagtactgggaaatgggagttcacagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaatgggctg

SEQ ID NO: 48416 - DNA, 2381 bp, Homo sapiens
  misc_feature (200)..(200): n is a, c, g, or t
  misc_feature (787)..(787): n is a, c, g, or t
  misc_feature (1119)..(1119): n is a, c, g, or t
gggaaagaagcatggagagtttggcccctccatggaagctcgtggctgaaatagaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcncaaggagtcaaagccaagagctccctgctgattcacaagcacttatgtcacttctgcacttcagtaaaccaggatggggattcgacggcacggggccacctcaccacacttccccaggatttcagggaacaggctcctgtgacttggaaataaaaagggatcagcccagcctggaggaacagcgacgctggtgtccaagccttgccccttgcctgcacttccagcaaagatttggagacacactcggtggaaatcgattgagcccccagcccaccctggcccagactcagccaccaaagttccctcactgcatgtggcacacgggctcatgggagtttctctgcctgtgtttgtccacgttgacaccttctgcacaggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcncgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggtgctgggcaccacaggcctgcagcttcttaggctctgggaggaggcgcagtggaaattgaggtcgccgtgaggtcgctccaatgtngccgtacactgttgctgcctggctaccttcccatctctgtcatcatggagagtgtgggcaggggacccctggccctcttccttcttctcctgccccggggggagcagcagagagccaaggggctggaggaggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcccacagtactgggaaatgggagttcacagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaatgggctg

SEQ ID NO: 48417 - DNA, 3032 bp, Homo sapiens
  misc_feature (1901)..(1901): n is a, c, g, or t
  misc_feature (2233)..(2233): n is a, c, g, or t
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacggggccacctcaccacacttccccaggatttcagggaacaggctcctgtgacttggaaataaaaagggatcagcccagcctggaggaacagcgacgctggtgtccaagccttgccccttgcctgcacttccagcaaagatttggagacacactcggtggaaatcgattgagcccccagcccaccctggcccagactcagccaccaaagttccctcactgcatgtggcacacgggctcatgggagtttctctgcctgtgtttgtccacgttgacaccttctgcacaggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcncgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggtgctgggcaccacaggcctgcagcttcttaggctctgggaggaggcgcagtggaaattgaggtcgccgtgaggtcgctccaatgtngccgtacactgttgctgcctggctaccttcccatctctgtcatcatggagagtgtgggcaggggacccctggccctcttccttcttctcctgccccggggggagcagcagagagccaaggggctggaggaggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggatacagtagggagatccaaaccgtatcagacgcgcctaatagatacagtaagagagtc

SEQ ID NO: 48418 - DNA, 3892 bp, Homo sapiens
  misc_feature (1995)..(1995): n is a, c, g, or t
  misc_feature (2298)..(2298): n is a, c, g, or t
  misc_feature (2630)..(2630): n is a, c, g, or t
atttttttcaaggatgagctttgccagctccacgtggaagtccctaaagctcctccttccacttcgaagcgtgactgatgcctccagggcctcacagccgcttctgaagcacttcctgaaagccagctccaccctggcgaggccctgacctcagcggacccaagcccaggacgatgcctgttgcgttcttctcccccagtagcaagtcaccttccccagcagcctccatgttgtctgggctctccctgtgggggatgccaggggagagtgagagagcagaggtggccaagatggcatgtgctgccttctctcctggaacatgctgcttccacagggcagtgccagtgtctccgtgtgaattcattgattgtggcctgagtgaattcctgggtttgctgttccagatgattctgcagggcttcaaaaccagcaaggccctgagcaaagctgctccttcttctcatgggctgaactcatcgtgatgtcactggctaaggggggcagcatggggtccagcccggcccaggcacatggagctgcggtcctgtcaggctgagtgtggtgtttgccttctaggatggccccgaggccaccagttccagagagggtctgtcaccgaaagacatccatgctgagtcacccaaagacatccatgctgaatccatccctctgccattctgccttgccccaccctctgccattctgccttgcctggccctctgccattctgcattacgcctgatttttggaagtgtggttttgagtgttggcagcccagtgtcacagaggaccatatcttagaaatgaccccaggcgagagctgtggctttcctgttctatttgaaggcagctgttttagggtgcagcgggtccagggacacagagtgggccatgagcaagggatgggtgctggggcctggcagagctggcaggctctgtgaccccggcacttaggaaggggtgggcaccgtgaccctggcactaaataaggaagggatgggtgctgtgaccctggcacttagtgaggaaggggtgggcactgtgaccccggcacttagtgaggaaggggtgggcactgtgaccccggcacttagtgaggaaggggtgggcactgtgaccctggcacttagtgaggaaggggtgggcactgtgaccccggcacttagtaaggaaggggtgggcactgtgaccctggcacttagtaaggaaggggtgggtgctggggccctggcacttaggaaaggatgggtgctggggcccggcagagccggcaggcactgtgaccccagcacttaggaaggggtgggtgctgtgaccccggcacttaggaaggggtgggcactgtgaccctggcactaaataaggaagggatgggtgctgtgaccctggcacttagtgaggaaggggtgggcactgtgaccccggcacttagtgaggaaggggtgggcactgtgaccccggcacttagtgaggaaggggggtgggcgctgtgaccccggcacttaggaaggggtgggcgctgtgaccctggctcttagtgagcaaggggtgggcgctgtgaccccagcacttaggaaggggtgggcactgtgaccccggcacttagtgacaatgttggagcctcacctcccagatccataaagcagggatcatgaaaaccaaccgaaggcagcagggcctacggggcactcagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcncaaggagtcaaagccaagagctccctgctgattcacaagcacttatgtcacttctgcacttcagtaaaccaggatggggattcgacggcacgggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcncgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggtgctgggcaccacaggcctgcagcttcttaggctctgggaggaggcgcagtggaaattgaggtcgccgtgaggtcgctccaatgtngccgtacactgttgctgcctggctaccttcccatctctgtcatcatggagagtgtgggcaggggacccctggccctcttccttcttctcctgccccggggggagcagcagagagccaaggggctggaggaggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcccacagtactgggaaatgggagttcacagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaatgggctg

SEQ ID NO: 48419 - DNA, 3476 bp, Homo sapiens
  misc_feature (1901)..(1901): n is a, c, g, or t
  misc_feature (2233)..(2233): n is a, c, g, or t
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacggggccacctcaccacacttccccaggatttcagggaacaggctcctgtgacttggaaataaaaagggatcagcccagcctggaggaacagcgacgctggtgtccaagccttgccccttgcctgcacttccagcaaagatttggagacacactcggtggaaatcgattgagcccccagcccaccctggcccagactcagccaccaaagttccctcactgcatgtggcacacgggctcatgggagtttctctgcctgtgtttgtccacgttgacaccttctgcacaggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcncgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggtgctgggcaccacaggcctgcagcttcttaggctctgggaggaggcgcagtggaaattgaggtcgccgtgaggtcgctccaatgtngccgtacactgttgctgcctggctaccttcccatctctgtcatcatggagagtgtgggcaggggacccctggccctcttccttcttctcctgccccggggggagcagcagagagccaaggggctggaggaggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacaagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcccacagtactgggaaatgggagttcacagtactgggaaaggggagttcacagtactcggaaatgggagcataggtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtgaaatgggctg

SEQ ID NO: 48420 - DNA, 561 bp, Homo sapiens
cggccgccccagtctccagaaatagtcacaagacatcggctctcacggtgttggtgtttagggaaagaagcatggagagtttggcccctccatggaagctcgtggctgaaataggtgcagagcccattttattaacgtttgttaagacggctcttttagataaacgggtgtatcaggttttgctttgcttccctgggctgctttgctgcctgcaggacaggccaggtgggtagggctctggccagcctgctgagctgtcctgtgggcactgtgcagggctgcagggatggtgacctgtctcagccccatcagaggctgtgctgagtggcactcacagcactcgtgttcacctcctgggcctggggctctcagcacgctcaggagtgtgtggtcccaggacccgctagccagcacctcggggtggccgccccactgcgtggtcctccgactgtggggtctctgtgcatcccccaaggtgcgccccacccagtgtccagatgtggggaaccccacaggccatctggaccctcagacagagcggcccctcctgagctggtctct

SEQ ID NO: 48421 - DNA, 1800 bp, Homo sapiens
cctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggacgctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcgggg

SEQ ID NO: 48422 - DNA, 384 bp, Homo sapiens
gacatgtgatccctaatattggaggttgggccttctgggaggtcatgggggcagattcctcctgaatggcttggtgatgagtgagttcttactctctaagttcatgtgagagctggctgtttaacagagttcggcccccttccctctctcaccatgcgatgcctgctcccacttcaccttcctccatgatggaagaaacttgaacccctcatcagatgcagatgctgcaccatgcttcttgtacagcctgcagaactgtgagccaaataaactgcttttctttataaattacgcagtctcaggtattcctttatagtaacacaaaatggactaacagaggtgccaaagcaattcattggtggaaaggactgacttttaacagac

SEQ ID NO: 48423 - DNA, 390 bp, Homo sapiens
aaaaaagtccaaatttgtacaagttcaactttatacaagtgaagtaagagaatctagaaacacagaaatattaactaaaacttcaggagccttgaaaaacaattttattgaaatacaggactcaaactaaacggaaatagattttgtgttaatattagcaactcagtagacagttatcaagccataagctaaactctccattttattttcttcttaaacttccttttacataatgaggaagtgatatcaatgaacagattacttatacctaccgtttctgcggaaataaaggagttagaatctagatcaggtataatgaacttgacagactttgtaaagttctgtaggcaactgggaatttcggttggactttgagtatggcagatcaaa

SEQ ID NO: 48424 - DNA, 271 bp, Homo sapiens
aaagctgcgagatagtggagaagatgcattccatggtgtttgctgaaaaccaaaattctgttttacagcatgaggttcctgtggcttcttacctactcagagtcatacaacagtttaggcagagaggtagagtctggtctcagatccggcacctatggataatgctgagctagctccctgcttccttgtgtacatagctgttgacctggtgcagtgaagaaggccttgggcagtcaggctttgccaaatctgattctgtgtcataccattt

SEQ ID NO: 48425 - DNA, 353 bp, Homo sapiens
aggctgttactttgtgtgaatcccttcacatgcccgtacctcacattcctcatctataaaatgaagaagttcaaatacatgattataagattatttccggtcctggtattctataactaaccttcctcaaagcagagagaaggggtgtatagtttaattgtattgttcccattcctacatcgattatatcatgtagtggcaaacatttgacctattttgttcctataggtatgtctgaaaattctgacatgaatgctttactcaaacatcacaaaaagtttattccagtaacttggacagtggtcctttctactattaggatcaggtagctattaatcaacaataggcatcct

SEQ ID NO: 48426 - DNA, 689 bp, Homo sapiens
ggacacagctgcactcgcccattctaaaaagtcagcgccctcaggcccgcgggtaaccacctcctcctgagcgtggtgaccagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcggtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctgggactgggacgtaggcaatggtccatcagctctctgccttccagccagatgttgtcattgcagcagacgtgctgtattgcccagaagccatcgtgtcgctggtcggggtctgcagaggctggtgcc

SEQ ID NO: 48427 - DNA, 334 bp, Homo sapiens
  misc_feature (280)..(280): n is a, c, g, or t
  misc_feature (297)..(297): n is a, c, g, or t
  misc_feature (328)..(328): n is a, c, g, or t
cccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaaggtttttgcttgtctgatgactgatggctccacccagacctgccaaccactcccgcggccccatccagaagtggctcagcgtgcatgaggaccatctccaacatccctgtgattgtacccccaaccanccagcagcaagaacctnttgcctagtcacctcccctctctttccccanctatca

SEQ ID NO: 48428 - DNA, 435 bp, Homo sapiens
aaacctatattataatggacctgaagaccataaggtagaagatcagaagaaaaagaaaatgcatacatttttatctttaaaacaattcacttttaagagtattttcttgaaaggtatacctttgatggagctgaatctagttgcttcaggcagatacaataggatacaataggataggacttcttgggtaaaaaaggtgtagtaatctgtgagactcaccggaaggagaaaggcaattatgcattaatttggctgaggccagggtagtaagcagattcattataaattctgacagcagaggaatacttgagaaatgcttatagttagatcatctatttttccaagcaatattcttcatgtcattccaccttgcaaaaactttgtggaatagaataggcatatgaagagcaatgaatagactttgcattagattgg

SEQ ID NO: 48429 - DNA, 689 bp, Homo sapiens
gctcctttgtgtcattgtatagttgtatgcacaaaaagtgcggaaggaaacatttaagaagttatagcttttattacagttcgagtctttagaatatcacaggagaacagaggagggaagattaatagtgagaatctcgtggttagagttctacatgattctgttcttaggactggagacatggaaatacggaggaatctttcagagctcactgttcgctagtgggagggcagtatttggtggaggcagggcagtcaggtagcacctgggggaaaaggatcttgacttcatgtttaaaacctgtttgacctcttcatccttcccactcacgttcccaccttgcccagttgtcaactgttgtgtatgcaggcagcatcagtttctgcccctcatttctctaagaatcttctaaaattggagattatcttgggtctctgagacaggaccttcttctcatccaccctcatatccctgcacagtctcagaactatggtaatgctgtggtaatctatagccacttgggtctggaggggagaaggagagactaggccatgtactggagcagatccaccttccaagcccccagctaagtgtgggtattacagatgaggtgaaggtgatcttttctcagggtccgggatgagaagctgaaaacctgaattagattataagtacttatggagattaaa

SEQ ID NO: 48430 - DNA, 1115 bp, Homo sapiens
tatgcagagtgctttatatcatctatgttacacttcactgtgacagcagtcctgtgagggagctatgagaggctcaaggtgctgtagttatagtaaggattctactcagatctgtctgggctcagagctttccccttcccataccccaccttactttggagtttatataatatttgagacaatatgtttgtgtgccttatttttttttaagtttcgtaagttctaagaaagcggcatttgttactttttagagagctcttccttgacactcccctaaaggcccaggctggatggggttgccctatcgccacggccgcttcaaagctgtcattgtgggttgccatagttatctgtgcagtgactgtctgacagcagtgttcactgtggaactgcaggctttatcagctcagaatccttatctgtgccaagcctagtgcctaactcatagtaggccctcttaaaaaattgagcaggcatgaatgagtggaaaccatgcttgttaatagcattatgtggcgataagaccatcattccttgacttgctccccaaaagtacaaagtttcaagcagacaaatgaacagatcattcttaaaattgaactaatctgggcaagcaaagagagttcaaagataaaagagggggacgcagtagtgcacaagggaaacattaaagcaaatattttcttttccacagaatcttttagaattcttgagggttacagttccagatatcattgctttaagtgtataaagtgtatttttaaaaagtgaaacccatacccatttaaaaattgaaaaatatgtaatcaagttgtatcagaacaaaaatgtgctttttgtgtaaaaagctaattaaatggagtcatcctatttagtgatttaaaaggatttgattaaaataatatccacttcaactactctcaaagggctgaggagagaggtttggtttccgtgcatcctggatggcctttgtctggtgtgattaaaggtatttcagtgcctgccatgagagaggcccctgccatttctgcagtttcagtgagaccgagaattcctgcagtgtcattccaactgtttgcagggtttagacagctgcgttcaggccacaaatatgg

SEQ ID NO: 48431 - DNA, 911 bp, Homo sapiens
aagattttaaatgtagaaatatttattggtttacaaatccttttaatcacttatacatgaaaagctttcatataattcaaaaagcaaattttaaattccaatgaaatagttcatcccgtggttgtgaaagagtgtttttagattgctgcacagaagcatgtttaacgtggaaatcagctcatggttttagttgttagggctacaagaaattgggggagacttcattccaagaaaacatgtagtctgtcaggctgttttcattcctctaaaagagacagttttctaagatgtttttgaaaatgagaaaatacgtaatagatctgcttaagaagtttcaaacttaatctgtgcttattacatgaatatgctaatgtaaaaccaggccttcagttagtgtttccttccttttagaatggtgtatgtaaagcaaaatataaactaatttctgacctgtcaaaggttttttcttaaaatttaaatttataatgtggtttggtttttctttcccactcaaacatgaatttgggtaataccaaaataaagctggatatataaattttatccaaaatttagaactctgttgttaagaaatctgttgaccacataaccatgtttctgagaaaatacatgattttttgcatctttaaaaaaaattagcactaagaagctaagatgaagttgtttttgtaatttgatttttttttccttaaaatactgttttggagttaaaagttgtagcaaaactggtataagaaagatgttttaagatatatttaagtcttgtctcatactctattgactaagctagcccggtgactagggtagatgtatttaaagaataacttttcccccttaaaatctcaatattccacatcctgttagacttcttgagtattaaatacatcttctat

SEQ ID NO: 48432 - DNA, 874 bp, Homo sapiens
agtaataggaaaccaagaatccagcctggtgatggctggagggagtgattgaagttagctgatgccatggggagttagccaggcagcaaaaatgtctggaaacccgatgtggccaagactgggctgtccagaagctcatcagagatagactcaatcagtactttctctcccaccttcctgaacaagaagaaaaaaatatgagagaattgagtttgtagtgttccctttttctccccccaggctggagtgcagtggcactgtttcagctcactccaggctcagcctcccaggttcaagtgatccttccacctcagccccccgagtggctgggactacaggtgtgcaccaccacgctccactatttttgtagtttttgtagagacaggggtctcactttgttggccaggccggtctcaaacttctgggctgaagcgatctgcttgccttggcctcccaaaatgctgggattacgggcatgagccactgcacctggccgagtttgtaatgatttcattcgatggcgacagagacataaataataacagcagcaacaacaataaacacttgttctctgccaggtgttaagcaaaacacattgtatgccttttctcatttaaacttacaacaaccatataaggaaactactattattattatttccattttacccatgagaaaactgaatgaatctcagagaggagcaaactatgtcaaaagtcacataattggatagtgagattatggtgtttgtactgaaatatgtttaacttcagagctcatgctctgaacacatactatactgctcatttattcatttattcacatatatattgtgcaaccacagtgtgccaggcactgggctgaaacaggagga

SEQ ID NO: 48433 - DNA, 298 bp, Homo sapiens
ttggaacaagaaatttacttctcagtagttttgcaaattaagtgtttaacttcgtctctatagaattaatgcctcggaggtggggagagggaggcagaggagaggctttcaaggccagttcacaagtttgacacttaaagtgatagtagcaagtttttctctaactgcaagagtgtgaagttctgtttccacctaattgcagtttgcatcctgcaagtgtattgatttagacattaaaacaacttaaatgtttagcagtaaaaagttgtttaatcattaaaccactaccattttcttt

SEQ ID NO: 48434 - DNA, 407 bp, Homo sapiens
tcatcagagatgccttccctggccactgtatctagactagcactcccatcccttactctacctgacgtttgtcatcacttgacatttattcacttgcttattaaaaatcattttcttctcccactagaacgtgagagcaaaagctttgattgttgtcattgctctgtctccagtagcaagaacagtatctgacacacgttaggtgctccatagatgtttgttagaggaatgaataaataaatataacagggaattggtctaatcaggaggtttggaaaaacttcactgaggccaggtgcagtggctcacgcctataatcccagcactttgggaggccaaggtgggcagatcgtgaggtcaagagatggagaccatcctggccaatgtggtgaaaccccgtctctact

SEQ ID NO: 48435 - DNA, 300 bp, Homo sapiens
cggggagggaggacccttcctcgcctctccagcttctgggaattgccagcaagcccgtattgcctggcttaaagctgtgtttcactcgcctctgtctctgtcaccacgccacacggcctccttccctagtgtaaggacactagacactggatttagagcccaccctaacacagtatgacctcatttgaactaattccatctacaaagaccctgtttccaaataaggtcacattctgaggtcccagtggacgtgaattttggaaggatgctattcaacccagtacaccttctataggctaa

SEQ ID NO: 48436 - DNA, 365 bp, Homo sapiens
tttatatttcactaggagtaggaggataaaagggatagatagaatagtctcattcaaaagttcctaagaccagctgatgatgagaatcacctgtttattaaaacgaattctcatacccaacctcagacatgattaatgggaatttcttagtggtaatgcctcggatatgtatcttttaaaacaacaagccctcttaggtgagtctgataatcacctgaatttggaaactattcaatcagaattagattaattggattctggacacagctatttttattagttatatgatcttggacaagttactaaaaacctgtatgggtctatattttccattgaccattaattttctgttggtacataatatt

SEQ ID NO: 48437 - DNA, 383 bp, Homo sapiens
tttggttgttaggatataaagaaaaataaaactcatgaaactaaatgagatcaccaaaagacagagtatatagaactaagaatggaacccttaaatattccaatattagaaagttagaagaggataaagctacaacgatgctcaagaaggcggcggcagagaggtgctatctattgcaagaaaacctgtcaactcaatgaaagtgtttcaaaaaagaaaagctgcattaaacatgtgccgattttaaaaacacatcttaatttaagaaacattaaaatagaaaaaaaatttacatatctcaattgatgtaattcactaatgtctacccaaaaggagagctaaacatattaaaacagaacagagaatgtataaaacaaatgaat

SEQ ID NO: 48438 - DNA, 378 bp, Homo sapiens
gcttcggggagaaagtggatggaagaggctccacgctggcttagtcacactgatgtatgaataaacgggcaagtaatggatgacctggggttcatgccagccaactcacctgcacacctgctttcacaagcacttgacaaggcacctacctttcttaatgtgccaagtacataatctctctgattctgtaaaaagattagctgttaggaagattacaaaactttgggtacaaaaataagagtatttttagaattttgttctccatgtgttaattttatcttcagtgggttttgtttgttttgctacctctgccccacatcataatttatgtgtgtgtttgtgtgtgtgtgctgaatagatgatctctaagtaggaaaa

SEQ ID NO: 48439 - DNA, 852 bp, Homo sapiens
ctagaaagtctattttgtctaatttaagcataactaccattgaactcctttggctattatttgcatggaatatcattttctatcctttcacttttagcctatgctcttaattcataattgagtctcttgtaagcagcatattacgaggtttaaaagtttcatttatccactctgtctgctttagtctcttttggctgttataacagaatatcacagactggtaattaataaagaacagaattttatttgactcatgattctggaggctgggaaggtaaaagaacgttactggtatctgttgaaggtctagttgctggataataacatggccaaagatgtgagggagagacagcttttttttttttaatatataacagatccattcttagtgcttatagcttaattaatttttaaaggttccacctcttaattctttcacattggccattttatcctaaattttggagatgacattcagtctacagaagtatctgtttagtagataatttaatctttttatttgtaaggtagtgataggtaagcagttactattgtacatttgtagttttctgtccattttaagtttgcttcttttttttctggttctgtctttcctgtgggtattgttcatttttgttgagacaaagttatgctttcttgctcagactgaagttcagtggcatatcacagctcactgtagcctcaatctcctgggctcaagcaatcctccccccttagccacccaagtagcttggactacttggacacgtaccacaacacccaaggagcttatgattcttccaccttggcctccaaaagtgttggaattataagcaggagccactgtatcca

SEQ ID NO: 48440 - DNA, 436 bp, Homo sapiens
tttttttttttaacctatgaacccaggacactagagccactttagtctaattttctgctctttaattattttaacactccagaggaggactggttttctcctgtgtttttttaatatatggcaagtggaacctctaatcgaccaccctgtttttcagcctaactcaggcttgtggtaaaattatcagttcccactttctttgctgcattctcaaatgcaacacaggagaacagctttcccttgcaaattcacaatgctgttaactatttgtcctttattatacatttcattaaagttttctattattggatttctttctacttctccctacagttctgcccatatttgctttttatatttagaagcctcccttttgggtgcataaatatatatagctatattcacttgacaaattaacctctattattattgtatg

SEQ ID NO: 48441 - DNA, 600 bp, Homo sapiens
tctgcccatatttgctttttatatttagaagcctcccttttgggtgcataaatatatatagctatattcacttgacaaattaacctctattattattgtatggtaaactcatttcatgcttgtgagagacattgctagaaagtctattttgtctaatttaagcataactaccattgaactcctttggctattatttgcatggaatatcattttctatcctttcacttttagcctatgctcttaattcataattgagtctcttgtaagcagcatattacgaggtttaaaagtttcatttatccactctgtctgctttagtctcttttggctgttataacagaatatcacagactggtaattaataaagaacagaattttatttgactcatgattctggaggctgggaaggtaaaagaacgttactggtatctgttgaaggtctagttgctggataataacatggccaaagatgtgagggagagacagcttttttttttttaatatataacagatccattcttgttaaaattagcccattcccataataagaacattaatccattcatgagggcagagtgcttatagcttaattaattttta

SEQ ID NO: 48442 - DNA, 570 bp, Homo sapiens
atttatacttgtttcctaagctttcctgcatttgccaccttaagcagagtcaagttcagttctcctggtgccctccaggtatcttaggctggattcccctctgacaaccacattgtggtttccataacaagcagctctgactagttctgtatccccaggcactagcatggtccccagtggctggcagcttaaactatgtgtgggtggtttctgggccagagtacctagaaggcttgggccttaaccctgtagcactcagttgcctttggtagactactcattctggtcttcaaccaccagttggctggagcacctcagcatttgcgttgagtttagcaggttaggactagccagagtgttaaactgcaagaaaaggaagcttaagcacacagtttagaagataaagggttatacgcaaaaatccaacatactccactttagagggccagactgtaacttgccaggtttcttgcccatggtcgtaacgctagcagggaaagcagaaccaaaatcagaacatggataacttgccttggcaacacagtgagaccccttctctaccaaaaaaaa

SEQ ID NO: 48443 - DNA, 339 bp, Homo sapiens
caagacctgaattgtctgaaatgacattcagcacctgaactctttgacactttggcacctccataaatctagaaatttctctgagttgtggtgcataggaaaccttgagggacaacccaggagtaactgtgagaaaaagggtgtcccagggagtaaatagatctcacagctcagaactgtagggacaggatgtcattttgcaccacagcaagtaggggaaagcagctctcaagcctaactgtgaaacgcccccacaaaccacctcctcctcccactccctcactgctgcctgccatggctacctctaacgcagcaaagcaaaactacaaaacatctctc

SEQ ID NO: 48444 - DNA, 863 bp, Homo sapiens
agaagaaagatgttacctgttctttcctggactgtggctatcagggtgccccaccacgatcactaatacatgtaccctgtttccatttagctgggcttgggccagagtccttccgttgtcacacgtcatatgaggctgtctgctgaggaattgtcttctgcttcatcgttagcatgttgaaatattgctttccaaagcatattctactttatcatttgtatttatgtaaaataatggaatggttattctaaccgtgcagtttcctatccttggttatttaattgcggaaagataacagtgggttttattttgctaaaatctgctaggaattgtgcaaaatctttgtgaaatgcccaatttcctagcttaagttatagatgtttgtatataagagaaaaagcctattgctaaaagcagcaatgtctttatcgatgcaaaaagctttaaacttactggccgtgtagtcagtaaaatgcatcagaacgtggcaaaaattgagaaaagcattgaagttttaaaatctgctatgcagttttcttcaactcccttgcaagatacttaatttgagtagaagacagaataaagtgttcccgttgaggaaagtgacagggaggaccgttcagaacgtgtttggaatctgagcagtcctgtcacgctctagtctgtgatgtggtggtgtgtccatggtaccactttatagaacttgaagaatgctgcttctgtgaataaaatacattttattcttggcatttcatttgtgagttttgagatgtgtaaaacgtgttaatggtttctttctcttacacaattacttgttctttttttttaagtacctacaagactctgaagcacataatcactta

SEQ ID NO: 48445 - DNA, 537 bp, Homo sapiens
  misc_feature (2)..(2): n is a, c, g, or t
  misc_feature (6)..(6): n is a, c, g, or t
  misc_feature (8)..(8): n is a, c, g, or t
  misc_feature (10)..(11): n is a, c, g, or t
  misc_feature (13)..(13): n is a, c, g, or t
  misc_feature (22)..(22): n is a, c, g, or t
  misc_feature (120)..(120): n is a, c, g, or t
  misc_feature (440)..(440): n is a, c, g, or t
  misc_feature (465)..(465): n is a, c, g, or t
  misc_feature (467)..(467): n is a, c, g, or t
  misc_feature (519)..(519): n is a, c, g, or t
  misc_feature (530)..(530): n is a, c, g, or t
  misc_feature (537)..(537): n is a, c, g, or t
gntctnantnnanatttcctgnaaaatagattaaaacttacaaagtgatacaagatttgtgctttcagccagaaattgtcttttaattggccagtacaaagacaagagaagctaaggganatggaataccatttgtgtcatttccatcacaccatttcttattctcagcacttactgagtgtgtaactgctgagagatttgccaggtgttcactcacagattgatagctccatgtataattccaaatgatagagatggagtgttgtgtcctctgatagcagaagcagcagccactgccttccccacaaacctgtcacaaagaaatcagtggggattggattttgccctgacctggataaaaggacacttcatcacagcaacagcctgctgggagaggagggaatagaccctgctcttgctgctgcagatgcctgcaaagnatctttacttggaggggtcttggancncctttctccgcagctacaccaagtgccaggtatatgtgcacatatacagtanccacctgcttncactgtn

SEQ ID NO: 48446 - DNA, 1295 bp, Homo sapiens
aaggctcaaggcagctgccttgctctcaatgcacggactaaggtttaaggacctcatttcaacgctcaaaaacaaaccccaagcacagggcaggccagctgagccccgcggtctgctgtgagctgccggcctcctctcctgagtcctgcccgtgccatggctccccgctaatccaccaggcagcgcctcgccctcctcctgtccctcgcgctgcctgagcctccagccaactcatcccaaggccaaggtaacctgagcagagatagcacggcacatctttaattgtgggggggatggagagataagagtgatgatcgcatgtgtttacaatacacagagacgcccagtgctggcaagactataataaagcgagcgtactcacaccactgcggctggcaccaaaaaccgggattgcagtggaaatgtttttggaaagcagtttggcaactgtcaacaaagcgactacagaacagttgtcaatgagacacagaaatacgaaggagaggagggagggcagaaacccagttaacaatgtaagcgggcacggagggaagatcagcgtgcaaagctaggtcggcaagacgtgcaaggtgcacccacagccataacaatccctccccagaccccaacgtgtcctcacggtggtggcagtggccccccgcactacagaagaacaatgcgaggcgagctcaggcgcgctgatggtggtttccgatacaactccccactcaaagaaccccggagagctcttgattccatctctcagtagggtcctgaagtccatgctgtctgaagacacagggtctccccctgcgtctgtgccaggacagagggactgccaccagccaagctgcaatccttttaaacgctaaaaacggccgggcttggtggctcatgcctgtagtcccagcagtttgggtggatgaggcgggtggatcccctgtggtcgggagttcaagatcagcctgaccaacacgaataaaccccttctctactaaaaatacaaaattaggccgggcacagtggctcaggcctgtaatcccagcactttgggaggcagaggcgggaggatcacctgaggtcaggagttcgagaccagcctgaccacatggagaaatcccgtctctactaaaaatacaaaaaaactagccgggcttgttggcgcatgcctgtaatgccagctacttgggaggctgaggcaggagaatcgcttcaacctgcaaggcagaggttgcagtgagctgatagcatgccattgcactccagcctaggcaacaagagtgaaatttcgtctc

SEQ ID NO: 48447 - DNA, 486 bp, Homo sapiens
ctgagatagaaatctaagatgagctgtcctggcagcaggaaagagagcgtcaggctgggaagcaggtgccacctgcttggaccccagaattcacccggctcaggcctctgctgcaggaaggatccctcgcctcccacataactctcgtctctgccaccttctctctgggccggtgcaagtcgctgggttgccaggcctggcttcagacagggtcgggtggaccaggtggggtttgcgccatcagatcatcttaggtgtcttacccattacaaagaagtgggaaagagatagcacctgtcgatgatagagctgcctgcagccctcagaccagccctgtccctcacctggggtgcagtcctgctacttagagcagtactgcctttgattcccttcacagctttccccctttcttcctttgtccttcttccctctggttttctcttccccttcttctcttcttccccttctccctctctctcatcatta

SEQ ID NO: 48448 - DNA, 610 bp, Homo sapiens
tttcctgccaagtgtaatcttaggaccacatctgaaatctgtgttatgtatgggtttagttattttatttgttatttcccaataatgatagcctttgcaaaaaccatccatcagaaagaggacataccttaaccatggagcccttggtactttcctcttcataccacagtatggcttgtgattccaaggaaaaagttgtgtaataaccttacaagcagcttcagttccttcctggtaaacctgtggtccgtggaacatgtgttttgatccagcagttcctctgccacctggaatcttgagataagtgtgtgggtcagtgtgcatgtgtgcccatacatgcttatgaggaggtcagtgtgtgaggggaatcaggaagtctcttttttatttttaaatgaaatcaagtaaaacttaaccttggcttcaaaaatatctctcaaatactgtaaacaatacctttgatactttttagaaagagattatggccaggcgtagtggctcacgtctgtaatcccagaactttgggaggccgaggtgggcagaccacctgaactcaggaatttgagaccatcctgggcaacatggtgaaacccatctctactaaatacca

SEQ ID NO: 48449 - DNA, 417 bp, Homo sapiens
caaaaaaaactaaaatatatgccactggcttgaaggccaggcagcaaggaaacttctcagaggctagaaggatggcaatccttaacaagcagtacaaaatatttggtaaaagtcagttataataacttgaaaagcagataatgtatttaataaacctacagctctagaggaagaggttaaaaaaactggacatttcctaacaggtataggaaaaaatgctcatcatgactaaccatcaggaaaatgcaaatcgacaccacaataaaatttcacctcactcaagtgagaacgtctattagaaagacaaaaagtaacaaatgctggtgaggatgcagagaaaaaaagaactctcacacactgtcagtgggaacgtaaatcagtacagccattacagaaaacagcatggagagggtcctc

SEQ ID NO: 48450 - DNA, 795 bp, Homo sapiens
  misc_feature (451)..(451): n is a, c, g, or t
ctcctgacctcgagtgatctgcccactttggcctcccaaaatgctgggattacaggcatgagccaccacacctggccatattgtgatatagctaacatagaatagaactcactttaagtgtacagcttgatgagttttaacatatatatacacacactgtagtcatgtaaccactgccccatcaagatacagaacatttcatcacccctagaacttcccttgtgacttttagctgtcaattacttctctctaccccccacattccccactcctgttcctaacaagcactgatctgcttttgcactaaagtcttgcctttcttaaagtttcctatagatgcagtcatacagatgtagtatcttgtgtctcacttcttttgctcaacacaatgtttttgaaattcatccatattccccgtccgggagggaggtgggggggggtcagcccctgncccggccagccgccccgtccgggaggtgaggggcacctctgcccggccgcccctactgggaagtgaggagcccctctgcccggccaccaccccgtctgggaggtgtacccaacagctcattgagaacaggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctcttgccttgggatcctgttgatctgtgaccttacccccaaccctgtgctctctgaaacatgtgctgtgtcc

SEQ ID NO: 48451 - DNA, 370 bp, Homo sapiens
tgactacaatatttaaactgctctgcccaaaaatacaacagcaagaaaggaagcttcatctactaatcatttgcatacctctataaatacttctgattcttactagcatacagacatcaatttcacctaacttttgagaagtgtatacatattctttttggtgctattttggatcccatcctttttattaagtgtagcttcagatgttctctaccgatgtaattcatgcatttgtcttttgatgcttgccatcttgtgttaatgtgtgggagcttgccattccaccttccaatttgaggtcatagggctgggtgatgaacattacagagctataaatatttctggtttttgttttgttttgacaaatgac

SEQ ID NO: 48452 - DNA, 358 bp, Homo sapiens
tgtaatttattgtggttttgggcaaaaagacttagaaataataaaactctgatatcttagtttacaaatatttaaattttcacattaaagagccttaaaagtttatttgaagcacgtaacagtatttttctttaccctgatctgtgaccaaccctatacattcttattcctagaaggaagactcttataggcactatcacagtgatatagagattcatgatgcagactgtaccgaaccaccttacagtatgctgtttgttcattagacacttgtcagcagaaatggttgaagaaacattataaaacacacatgggtcctttcaacaaatgatgtcagttcaacatctacatgaaaaaa

SEQ ID NO: 48453 - DNA, 409 bp, Homo sapiens
gctactcgggaggctaaggcaggagaatcgcttgaacccgggagatggaggtttcagtgagctgagatcgtgccactgcactccagcctgagcaacagagagagactctgtttcaaaaaaaaaaaaatattttttaagctatctcctacaggaagaatattttctgtttgtggatttgcctattctagatatctaatatacatggcattatatatgtggctttgtgactggctttcttgtagcataatgtttcaaggtccgtccatgttgtagcatgtatcagcacttcgttcctgaatagtatttcattgtatggataccacattttatctgttcattagttgatgggcatttgggttatttttatcttttggctattgtgaataatgccactatggatagcccactt

SEQ ID NO: 48454 - DNA, 258 bp, Homo sapiens
aggggaggagaatgaactttggtgcacagcaagcagtctctgccacagggaatgacacgatcctttgatcatagcaaacaagtccatttcatctcctaaaggtaataaataattggactacattacaaagcagtaactctggctgggcgcgttagctcacgcatgtggtcccagcattttgggaggccgaggcgggcagatcacttgaggccaggagttcaagaccagcccagccaacgtggtaaaaccccatctcta

SEQ ID NO: 48455 - DNA, 680 bp, Homo sapiens
aaaagaataaagtgaattggtgttggagagagcattaaaaagagagagagaaagagaagagccaataaaaacatgtggtttctaaatgtagatccactaatttctctttgtggcagtcatttggtctatattgtttgaatgcactaggagacattgtacatattaatgaaattaggtttgttaagcttgtttgctagagatgtaagccctagtaaaaaaacttcaactttgagatctgacagtctcaggtctgccacttactagctgtgtgatcttgaacaaggaattttgcctcttttgagcatcagttttctcttctgtaagacgagagaaataatacctagcctagtgtggttgttatgaaaattatatgagatgatgtatttatgcatcctacaaagtctctgacacatagtagttgatgaatcactcttagttctattttcaagtaagtaaagctgctgatctcatagcccatatttttataaaaatgtactttcctccttggtaattgtgattctgctgtcttctgtctacttcttgggactctggtgccgagaacctttctgaccccttcctgcctgccccatggtacgctcagagagtagagacttcgcctattttgtccactgctctagactcactaccaggtgctcaataagtatttgaggtgtatatgt

SEQ ID NO: 48456 - DNA, 313 bp, Homo sapiens
atcaaggcaccagcagacacagtatctggggagggcctgcttcctggttcactggcggctggccatctcctgaagtggtgaaggactctctggagtcccctttgtaaaggctctaattccattcgtgaaggctgtaccctcatgacctaatcacacaccaaatgcctcacctccaaatagcatcaccttggcgatcaggtttcaacataggaatttaaggaggtcagaaacattcagttgttagcagcatcatactgaaatctatagctcagggcagcacccagatggaggtgggaaagccttaaattcttag

SEQ ID NO: 48457 - DNA, 458 bp, Homo sapiens
cctcacaaacaactgtggtaacaatacaaggtggtgattatcacctgcttggagactgagggaccccagaattggtcaggccctagggttcaaagcccagctcccatctggagccaaaatcactcccctttcccaatgaggaaagatcaagcgtgaggcctccgtaccttctccccatctgtagaaacgatcagcttttatgatcatgtccacccaggctgacatggttgctgcggacggccactgccagggcggtttttccctgctgcaattaagaggcaagaagagaagccagagtttctacaggaggggtacacaagggtttctagcactgaggacaaaccctcctgcccacaggaagtgctttccagcagtctacgctgagagcagaaaggttttctggttttctgggcatgaaggggatatggaaaagtcacaaatagaataaagcaatagca

SEQ ID NO: 48458 - DNA, 385 bp, Homo sapiens
gagagtgatagaggtgaccaaataaattagtgaaacaaagaattgttgaataaataggactagtaaattaattatttgaaaaggtaaaagaaagtaaattaaaacaataaaataagtcataaacatatttgcttaaattataaatgtcatacgatacttaaggtcaagtagcaaggtcctcataaaaataactgataagtggaacctaaataaaattgtcaaaaaattagactcataatcataaaaagtaaaataagaattatagtaataacaatagcacctatcatttgctgaaattctacattctctcaaaaaacctgctaagtgaattatttataatagcacacgtaaccatctattaatcacattactctgtaaacttcaa

SEQ ID NO: 48459 - DNA, 322 bp, Homo sapiens
tgggaagctaaagagctcagctcaaaaccttctaaggggagaaccaagggatctcccaaagcatttacaggctgaggagaaagagaccatgggcttccaatcaaaagaccatgctcaaagggaaggtccaactagggactgagttttagtaaaataacaggccagccctgacccagatcaatccctcatgaaaccaaggtccttcacccctcactccatatgcctaaccaagggcaaagagagcttttgctttgatgaaaaacacgacaatccagaggttttacagtcctttatgcacaagtccagcaaacactcacaattt

SEQ ID NO: 48460 - DNA, 492 bp, Homo sapiens
ttttggtttttgagtgtgtcctttttagctttgaaccagttttgagtttctggggaaaacttgggaaataggaattcttggactttacactgaactcacttagtttcaaaaagatctcaggcagcctaggctaacctgattgtcttgagcagattgggagactccaagtccccagacaaaacctgctgttatttggaccttttctcacccccagaaactgaggtgattcccaggacaggtgtttattcctctgaccaggagatctaggtggtctgctagtaccttcaaggtcctctgcagtattttctgtgatttgggggctacagtgagctccctgaaacattctgcaaacatttgagtgttgcaaaaccccacagggacctgaaatgttgtcctttacccattaatttacagcaatactacatgtagaaagaattggggcccatttttttgtttgtttgtttgtttgtttgttttgagacggagtcttgc

SEQ ID NO: 48461 - DNA, 2424 bp, Homo sapiens
  misc_feature (4)..(4): n is a, c, g, or t
  misc_feature (9)..(9): n is a, c, g, or t
  misc_feature (11)..(11): n is a, c, g, or t
ctcncagcngncagagagaggaggttgtctgggacagactgctcctgacagaaggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggtgagggccccagtgtggggctagagaggggaccgggatctctcccttccaggaacagggtgggtagacccccacaaccttcccatcccccttcccccatcctccctgaggccctcaatgcatgggtgctgtctaccttcgggtgctgaagcagcccagagacccaagcctgccttgctgccccccaggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48462 - DNA, 2225 bp, Homo sapiens
  misc_feature (4)..(4): n is a, c, g, or t
  misc_feature (9)..(9): n is a, c, g, or t
  misc_feature (11)..(11): n is a, c, g, or t
ctcncagcngncagagagaggaggttgtctgggacagactgctcctgacagaaggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggtgagggccccagtgtggggctagagaggggaccgggatctctcccttccaggaacagggtgggtagacccccacaaccttcccatcccccttcccccatcctccctgaggccctcaatgcatgggtgctgtctaccttcgggtgctgaagcagcccagagacccaagcctgccttgctgccccccaggccatgacaccacggccagtggtctctcctgggtcctgtaccaccttgcaaagcacccagaataccaggagcgctgccggcaggaggtgcaagaacttctgaaggaccgtgagcctaaagagattgaatggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48463 - DNA, 2367 bp, Homo sapiens
  misc_feature (4)..(4): n is a, c, g, or t
  misc_feature (9)..(9): n is a, c, g, or t
  misc_feature (11)..(11): n is a, c, g, or t
ctcncagcngncagagagaggaggttgtctgggacagactgctcctgacagaaggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggtgagggccccagtgtggggctagagaggggaccgggatctctcccttccaggaacagggtgggtagacccccacaaccttcccatcccccttcccccatcctccctgaggccctcaatgcatgggtgctgtctaccttcgggtgctgaagcagcccagagacccaagcctgccttgctgccccccaggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgagtcagagttcccacctccctcccctaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48464 - DNA, 2435 bp, Homo sapiens
  misc_feature (4)..(4): n is a, c, g, or t
  misc_feature (9)..(9): n is a, c, g, or t
  misc_feature (11)..(11): n is a, c, g, or t
ctcncagcngncagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48465 - DNA, 1851 bp, Homo sapiens
aggctgtacggcccggaattttgggatgtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48466 - DNA, 1843 bp, Homo sapiens
cagagaggaaggccatgaggtgagggctctggccatggtgaccaagaggggtctaggagtgcaagatggacttggatttctggaaaaaggatgaatcttcagagactgtctcagattagactcaagagcccttagagctagtgtgactttttatgggggtgggggttggggggggttactgccttctctccaggatgaagacgggaagaagttatctgatgaggacataagagcagaagctgacacctttatgtttgagggtgagggccccagtgtggggctagagaggggaccgggatctctcccttccaggaacagggtgggtagacccccacaaccttcccatcccccttcccccatcctccctgaggccctcaatgcatgggtgctgtctaccttcgggtgctgaagcagcccagagacccaagcctgccttgctgccccccaggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatatt

SEQ ID NO: 48467 - DNA, 520 bp, Homo sapiens
atgggagcaagcatttcccattttcatgcccaaatgttgccttttccaagaccactctggcctgccacacccctatcctgtgcccatataaaccccaagctctacaagcagaggaacagaagagcagcagagtagcaaaatggcatggcagaggagagaagagaaggagcatctgaatgtcaggaggagttcggctgaggacggttggaaagcagataagccggggatggctgaactccaggggaagatcatcttcccactccatcccctttccagctccacatccattcctctgagagccaactccattcacttcagtaaaatccccaccttcactattcctttcaggtttgatgttgacctggattctttcctaggatggccagacaaaggacgggttaccaaggaggaggcagaattttaaaagggctgttcaccctggattcttccattgagtggaatagccatccacgaaaagcaactgctaaagagcactaattgtaacacacccctagatgct

SEQ ID NO: 48468 - DNA, 528 bp, Homo sapiens
agctttttccaaatcatgtaattttttaaaaaatctcctaactagatttcatatactcctcccattaaagctacttacttaaatgaagatcttgaaaaaacaaatacatatattgaattttattgctgagactgcctaaagacttaagacatgaaaaatcttatcagtaaactgttataaaaacaacaacaaaagccctatatgtaaatgtaaaccaagcaccttttaatttctctatgaaggttagataatgctggtggccttgcaagtaggcctccaaaaggggctggccatgctgtggcaccgggtccacttcccgctcttagttctacctctaacaaggagacagagaatctagaactactgccaggattgttacagaaggacacattacaattttccttaactgttatttgtttttcatgtttaatattgtttataaaaaaagttacttcactgtaaaaaaaaaaaagttgtacataaacttgatcactgtaagataatcaaattgcatttcagttgcaagta

SEQ ID NO: 48469 - DNA, 811 bp, Homo sapiens
gtcaccctgagtgccaccaggtcccctctgcctttggtccagaagagtgagttgtccaaaccagccagcatctggctccagccctccaaccctggcgaccagaccccatggggtgccatcaacggccccgcgacaggcatcaattcaaaccccaggacactctcgacagctccaaccatccggagggctgtgcagatggcaggaaccaaggaccctccctggcagctgaagagggcagttacggttgggcgtggtgaccagaacacacccagcagcctgcgaagcctccccgtccccagcctgtgctcctgattcccgccagacgcttgtgagcctgtgtgggtggcaggaggccccgtcttgccgtgcctacctgtcgcacagatgcctctgcacgctgcagacggtgcctctcctctcctatggaccctcgtcgggggcaggcagcggccgggtccaaacttgctgctgtcctcgaggctggcactgctatctccagggctgggttgactcaagccagacagggggaaggaattggttctgcaggacagtgagagggtctgtgtcccggcacccctgggacagcgctcggctgcctgtgctcactgcatgagaaaactcagagggtgcattctccctctggcatggctgtgtctgggcgccttgggctgcggcagggggcaggccccacgtggggaagcctcgtgcttggtcagctttctgtctctcccaggccagtgacaactggcttcccgaggaaggaggtgaggtaccagggaccctgggcaggacctggtgtcgggcagggcgg

SEQ ID NO: 48470 - DNA, 413 bp, Homo sapiens
gtttttttttaacatgtcaatcattccccgtgccatttacctagcactgagaccacaatatgcgtgaactttaacttcacttttcaaccttgtcttactgttaacattgacaggcgtttttgtttagactgaaatgttgcctctggaactgacaaaatgcagtggtttgcattctcttgcatggaaagaaaaactcaacttacaaaacagagaagtggaacacaatagctttttttttttaatgtcagaattataattatcttgagccttaggcccctcacatatttttctgtctcgtttgtgtaaacgactctgtcatgcttcagtatttgtgaaaagagtctgaaaattacagacacaagtgtttagaaatttccccttaaccctccctgaaatgacaataaacaaaaaaa

SEQ ID NO: 48471 - DNA, 745 bp, Homo sapiens
attttaaataaagtaggcaacggtatagtaatatccttcccccaagacacagagttaaggcaacttaatatgtttgtatgtaagaggggaaaaaaaggtgacacagatgtaaaccggaaggcccaaggttcttatctttgggcagaggattacatctgggtgctttttattttccatttgctcatcggttttctgaaatttccacagcagactgttaccttggtagtgagaaacaaaatgatacttgatttttcaaagagggtcatttatacctgtccccagcctcttccgcctcccaagtgaaatggggcttgccagctgattcatttatgttctttcttgttttctaagttagtatattgctcaaaacagcccttgcgagctctaggagctcaggagcagtttggtgtccctcaaagcagccccttccctaaagctacagcctctgggttaaggacatgtagcagaggtactagtgtgagatgtctgggttttctggtttgttcttggacccacaaagcgcagagagctcccaaacatgttctcaggatgggcgaggatagaaggtgtaagtcttggtgcctatctgcaagtgaaggtgtttttaagacaccatgtgcgtgagcatgtgacccatgtggtttatgatgctgactttttcctctggggaaatgcgaaatacttaaagctcttatctgtctgtactgattttgaaagccaagagcctaagattttgacaattagt

SEQ ID NO: 48472 - DNA, 471 bp, Homo sapiens
tgacttcgatataaaataaaagacgagcctgcagctgtctgcagagaagaggaaatcataacaagagaagcggcacagtctaacctctcaccaggtcacaggccccacgagggcaggtactctcctttgttccctgccatgacccctagagcaatgccctgcccacatgggagctcagtagcaaactaactaaatgaacacactggactaaggacttcagggaggggacagggcagccatccgcctgttctgggtgagcctggtgaatcactctagtcagtgagcagataggtgagaggaggtgattaaccccaaatttccctttcaacgtgacatgtctctgtgtgaacgcaggcgctaatgaaaaaacaaacccagccacagaacggcctccaatagtggagaaaaacaacccagaggtgtaatgactattgcaaaaagctgaatcctttaggccaaaacaagcacccc

SEQ ID NO: 48473 - DNA, 213 bp, Homo sapiens
tttgacacaggtaaacagaatgcaaagtttattctcatttttagctagagggcacaagtcctagtacataaactcaaacgaaaacataagcaaaaagattaaagtaatgcgcactgagtcatgaacccagaatagacagctctgaaagaaaattagagtatgggtgagcaaaaacgttatttcctagagaggataccaccttaaacacaactt

SEQ ID NO: 48474 - DNA, 233 bp, Homo sapiens
ggaagactgaggcaggaggattgcttgggccccagaggttgaggccgtagtaagccatgactgtgccactgcatgccaccctgagctgcctcagaagggagaagtttctttctactgtttctggccccaccccacccccaagggccagcagggaatccctctggaatttcctaaggaaacttcttttcaaaagacaagaactcctccctaggaggctcatcaaacaaccagga

SEQ ID NO: 48475 - DNA, 541 bp, Homo sapiens
agcaattcactgcatccctctgtgcctcagtttcccattctgtaaatcagagatcatgcatgctacctcaaaggttgttgtgaacattaaagaaatcaacacatggaaatcaaccaacatgggtcctggaacagggcgttgtgctcagtgctttctggtctctcttccttgaatagaaaggtcctgctggcaagttctctcaaggctggggatgaccaggcacaaaaaacagggcagcaatatgttggtgtcactccccttcccaaaactcttcgaagactccctaggaaagaccagcccctcagcctggcacttggttcatgatgtgggatcttatatccttgccagagtcatatctttgcccacttttacctgcaatccttgcatcatattcctttggctccagtccttcatttatgagacccataggaatccttccaacagccaaagagttgagtctaactctttcctgcccaaacccattcacggccccctggccttagacaatatatcacaagcatctcccctgacacataaagtc

SEQ ID NO: 48476 - DNA, 350 bp, Homo sapiens
gcctttactatttactgttcttatgtaaatccaaaggagaccatagtcagcagtgttttccaaacatttttaatcatgaagtttttgtttcatttttagaagtactttatgggtaaagtgttccataaaacatattttgggaaatgtaaaagctaatatatgcaacaaaaattacttaagacttttaggtttcaatatatttcattctctgcttatatgtgtgtgaacatccacacaaagccagaaacataagccaacaactggttcaacaatatgccataaaaatcaaactcacagtctataatatagaataaggacttttaaaactagcatgggtgtattttggttcc

SEQ ID NO: 48477 - DNA, 370 bp, Homo sapiens
gaattggcattattaatattatataatattctgatgtatttgactgatgaatatttgagagtggctagtaactattaatgacattattagttcatcaaaaccacactactttggaaaagtgggtcatttgattgtaatcagaattttaagaaagttggtagaaatttacaatgaagatagtttgctaatatattaatagtgttgatagctaggaagtatatttggaggaattttcccctttaaaaaaaaagtctgggtgtggtggctcacacctgtaattccagcactttgggaggccaagataggaggatcacttgaggccaggagtttgagaccagcctggtcaacatagcgagaccctgtctctgtt

SEQ ID NO: 48478 - DNA, 341 bp, Homo sapiens
attattttaaaatatttattttatgtacaaaaaggtaacatggtttctctcattgggtgggtgccttagataatccattcgtggaagatcacttagtccaacttaatgaaatctatatccttcacgtatgatggaaacactggtggcatgtaacgaggctcaatttccagatcagactgtgcccagtttcagcagacacaatagcaagaaccctggctgacttttcgcgggtggctccagtagagctgctggtgaatcatcttgctttcaggagtgcgacagggcaaaaggaacaataattcttcatatccatctactacagtttcaaagcacttcagtta

SEQ ID NO: 48479 - DNA, 324 bp, Homo sapiens
caaaaaccaatggaagagaaacacttcaaaatgggtgagaacagagaacagcatgaaatatggacagcagacagccctgtatgcaatgaaaatgcaggtgcatggtcactagaaaagatgcctcattctttgaatttttggctctttgaaacacctgtgtgacattaaattttttactgaaatgtggtattattaagtcttgcgtttaagtttataatcagaaacaaaaacaccatgtcctgttaaggaaagagttattctgacaacggttagcaggataaagaagattttactcaggagtattgcaataggtgtcaagattcc

SEQ ID NO: 48480 - DNA, 449 bp, Homo sapiens
tgagacagagtttcactcttgttgcctaggctggagtgcaatggtgccatctcggctcactgcaacctctgcttcctgagttcaagcaactctcctgcctcagcctcccgagtagctgggattacaggtgcccaccaccacgcctggctaatttttttgtatttttggtagagacagggtttcaccatattggccaagctggtcttgaactcctgacctcaggtgatccacctgcctcagcctcccaaaagtgctgggattacaggcttcagccaccgtgcctggccacttattagcttcttagaatcaacccatatgttattgtgtcatcctttcctaaaattatattttcagattagaacatgaaaggttaaaaactgaaagggcaaacccaaaccaaacactgtctgctattttgatattaattaaaaacagggtcaaactcctga

SEQ ID NO: 48481 - DNA, 706 bp, Homo sapiens
cgtttcttggacactgtgctttcccgtttgtaactcaggtttgatcaggcagttggtgaagaccgtccctctatgggtgtccctagtagtgtggggacatgttccctactcagcgcatcctgtctgtgcctggagatccctaagtggggcctagtgtgggttgaatctaagtagttaacagggttgcgcatttgcaggggcagcatctttccagtgagtgatgtgttaaattcccatgtctttgtgcagtgaagcaggactaagaatggatttctggactttttggaagtttacccctttctgaattgcttctgtaagtggcagtgccatttaggatgtactgcataagtttttggctgggattttaggactgaaatacatgtaggtggccatcaaatcagggtttcattgtatcacattaaataaacatgataagttagccaggtgtagtgactactggggcctatagtcccagctgcttgggaggccaaggtgggaggatcacttgagcccgggaggttgaggctgcagtgagccatcatctcgccattgcattccagcctgggcgacagaaaaagaccctgtctcataaatagataaataagaacatgatgatttttaaaaagtcataaacccagacaaagcccgggtttccaatgggagcataccaagttaaactcgagggggggcccggtccccaattttg

SEQ ID NO: 48482 - DNA, 325 bp, Homo sapiens
gcagcttaatttttaacagctctaagatgttttttcatacaaagataccatgatttatttaatgaaatgcatgtattttagtattatgggtgttgattggataaacgtaccaccaccccaacagcagcacatttctcttatttcgacattcactgccttaaaacatttaaaaattattctgggatttgtggtaagttcagaaaaacacttgaaacagattcagttgctcccaggctaagtgtttatgagaacttgaggagtgtgggcacaactctcagtctctctctgcactccagcctgggcaacaaagcgaggttttgtataa

SEQ ID NO: 48483 - DNA, 439 bp, Homo sapiens
ctgcaactactgggaatgcactttccactgagattgctgagctggtctagtaagtctcaactcaaagagaaaaacagagcttagagagaccacgttttgatgaatcatgtgagcccctgggtcctgccaaaccttaattcagaacacctgtagacttttccgttttatgagctaatacgattattttagctgtttactttaaatttctgtcatttatttgagacagagtctcactctgtggccaggctggtctccaactcttgacttcaggtgatccacccaccttggcctcccaaagtgttgggattacaggcatgagccactgcgtccagccatgacatttattttttaaaacgtgacccataatgccattttcctttgccaactagacttttgatttgtgactatgcctgaggggaccacacaaggaagggtgtta

SEQ ID NO: 48484 - DNA, 816 bp, Homo sapiens
cttgtgttcatcaactaattaatggataaaatgtggtatatcaatacaatggattattattcagccataaagaatggatgaaattgttatatggtacaacatagatgagccttagaaacatgctaaatgaaagaaggcacataaaggcccatgttgtatggtcccatctatatgaagtgtccagaataggcaaatccacagagatgggaagcatactagtggttgccaggggttgaagggagaggggaactgggactcactgcgaataggtactgctaatggcatgatggagatgttctgtaattttagtggcgatggctgcacagcacagtgaatatacttaaaatcaatgagttttattctttaaagtggtaaattttatggtatatgaattatctccatgagagatctatccatatattgtttactaaaacaagttttagttccccaagtaattatattccaaggaacataggaggggcaaaaataattctaaagacataaagaaagaaacaggatattttctaaatatttttatcttgagacagaacttggttttttttttggctttagcttggaaaatctcgtgtcatagataaatctttctcctatcttgaaattggtcttatcaaggaactacccgcattgagatatgaagctctgggcctctctggtagccttgcacacccttcattcatcacctggtcccccagataagacagccctgacctcagaatacaccttggatttaacattctatgggacatttatttctagtctaccccctcccccgacccgccggaaacaatgcctttc

SEQ ID NO: 48485 - DNA, 835 bp, Homo sapiens
gtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcaaaaaaaaaaaaaactcgggttttggtggaaagaaagaata

SEQ ID NO: 48486 - DNA, 795 bp, Homo sapiens
gtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctca

SEQ ID NO: 48487 - DNA, 749 bp, Homo sapiens
tggtttagcggtcctctctttgaagaacatggttttgttttgttttgttttgttttgttttgttttgtttattagagatgcagtatcactctctcacccagtctggaatgtagtagctcaatcatagctcactgcaacctcaaattcctaggctcaagtgatcttcccacctcagcctcccaagtagctagaactacaggtgcatgtcaccatgcccagctatttatttatttatttatttatttatgtagaaacagagtcccacttcgttgcctaggctggtctcaaactcctggcttcaagcaattctcccacctcgacctcccaaagtgctgagattacaggtgtgagccaccacacctggcctgaagatcacatatgtcacgtaaagtctattaagcttgactacactcagggtacagtgcagatgctgggtcccatggcgctcaagagggaaggagtccctggacctgcctcggtagaactttatcagttctatctcattgtctcctttaagccccacggcgatcctatcttcccaatgacacactgtctcttttcctatatcattaacaggtaagaatcaagttgtaaacagaagaattaggaagccaaaaagcaggaaagctgagcaacacactcaaaatctaatcgctgcctgagaaatcaggaattgactctaaacacttggacacagcatgtcaccaacacagtccaactctagtgaggaggaggagagcgaggaagag

SEQ ID NO: 48488 - DNA, 442 bp, Homo sapiens
cagcctctgcttcactaggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtttccggcctccacattggaagctgaaggagctcttacaaatcctccctttccttagacatcctgactccccggcgactcccatccttcatccttcccccattatctaatccccatgaccctcacctcgtctaccctcctggttttccattgagtgttctgtacactttctttgacttctagtcttactcagtgaccgccctcc

SEQ ID NO: 48489 - DNA, 961 bp, Homo sapiens
gtcacttcccctgtgctggcggtcccagcggctctctgagcgaagtcactgagcgagccgccaggctatgaccccaggggctctgctgatgctgctgggggcgctgggggcgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcagagagaagatggggctctcaatctttgtacagctgacccagagtagcaccagcacgattccacgggatcctcaga

SEQ ID NO: 48490 - DNA, 2249 bp, Homo sapiens
  misc_feature (1728)..(1729): n is a, c, g, or t
  misc_feature (2011)..(2012): n is a, c, g, or t
  misc_feature (2015)..(2015): n is a, c, g, or t
  misc_feature (2019)..(2019): n is a, c, g, or t
  misc_feature (2023)..(2023): n is a, c, g, or t
  misc_feature (2026)..(2026): n is a, c, g, or t
tgagatggaccagcctttggtgaagattggatcgaaatcagaccaatggacaagctctggccgtgggtggtggacgggcctggagtagaactggaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagaccaggccccctgccagttgaagtgagagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggnngctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaatnnctngttnctgnagnatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctct

SEQ ID NO: 48491 - DNA, 2420 bp, Homo sapiens
  misc_feature (1899)..(1900): n is a, c, g, or t
  misc_feature (2182)..(2183): n is a, c, g, or t
  misc_feature (2186)..(2186): n is a, c, g, or t
  misc_feature (2190)..(2190): n is a, c, g, or t
  misc_feature (2194)..(2194): n is a, c, g, or t
  misc_feature (2197)..(2197): n is a, c, g, or t
gtcacttcccctgtgctggcggtcccagcggctctctgagcgaagtcactgagcgagccgccaggctatgaccccaggggctctgctgatgctgctgggggcgctgggggcgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagaccaggccccctgccagttgaagtgagagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggnngctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaatnnctngttnctgnagnatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctct

SEQ ID NO: 48492 - DNA, 256 bp, Homo sapiens
  misc_feature (245)..(245): n is a, c, g, or t
cgctgactggttctctggcagctctagtgactctctcctccatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagataatcacaagcctgtcgggctagtcgggtaantcctgagagtc

SEQ ID NO: 48493 - DNA, 2039 bp, Homo sapiens
  misc_feature (1518)..(1519): n is a, c, g, or t
  misc_feature (1801)..(1802): n is a, c, g, or t
  misc_feature (1805)..(1805): n is a, c, g, or t
  misc_feature (1809)..(1809): n is a, c, g, or t
  misc_feature (1813)..(1813): n is a, c, g, or t
  misc_feature (1816)..(1816): n is a, c, g, or t
tgagatggaccagcctttggtgaagattggatcgaaatcagaccaatggacaagctctggccgtgggtggtggacgggcctggagtagaactggaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagaccaggccccctgccagttgaagtgagagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggnngctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaatnnctngttnctgnagnatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctct

SEQ ID NO: 48494 - DNA, 510 bp, Homo sapiens
tatgtgaagcaagagattatgactctcaaccttccgaagaaattttaatgcagttcattctggtagaacaatacctgcaattgaacgtccacgtcagggttctctgcttacagagtaaattctctaaagtcatgtacaagaacaaaatagcctccctatgtgctttgaatgctattggttctcagtagaaattagatcgtggtcatctcaaatgcaaacaataggaattatattttctaagatctggtttcttaagccaacattaaatgttaaaagtgatgccgtttggcagtttctagacatgtgatattttaaacaaaaagaagccactttgttatctttagggagataaaaacaattttcatttggtcttcaggaacaaaataagcaacttccttttacaattttaaccataaactgttttgttacttgaatattgtgttgtagccaacaagtttgaatatacagtcatgttcttgtcttgaaattttagtattgataacatagtat

SEQ ID NO: 48495 - DNA, 407 bp, Homo sapiens
gacatgaggcccctccggcaggcactgcgtgagaatgcccagtgttcttgtggccgatgctggctaagctcctactgggtgcccagcctcaggcctggtgcaggtgggacagagctgtcaatcatcagtcccatccgtcagtctgtccgtcccccatccagccgtccaggatagaactgtggtttggcgcacaggttctggagggctgggttgaaacccactccaccaaatccttgctgtttgtcctttggtgcattgccccaccttgccagcctcagtttcttcatctatgaaatggatataataacagttcttacctcatagggttgttgggaggattaaatcacttaatataggtaatgccttaggcacagtgcctgccacatattaaatgcttgctaaatgtt

SEQ ID NO: 48496 - DNA, 480 bp, Homo sapiens
gtaagggaggtgaattcagcacctgaagatgctggctgtgcaattgagaagtggggaaggggagaatgcatgatgagagattaataccaacctcagggggctctccctatgtgtcccgttgcttattcctgcctgctgataattctgttcccagaaaactttgaagtttatttcccagcattatcacaacagtaatggaactcccagtaaaaattttagtgacccgttgtttgatttaaattatttattgcattacatattttagcatttttgaagtaagagatactgtagttctgttaaggatgaaaaccaagtcaaacccataagcagtcagacttgttttaaattggatggtaccagaggtttttaagagccacctgaaaaaatagaaaaataaagacacgaaatggtttttgaggttttacataatccatgtttctacaggcgacatgggagctaggagagtaaaaatagggcaaa

SEQ ID NO: 48497 - DNA, 280 bp, Homo sapiens
cagggccactggggtctcccaggagcacctccagccctgccccccatgcccagattgtggggagcacagggctcgctccactgtccatggaagaggttggaaattcagcccagccatccccaccccagggacaggcctcccaggagctcacactcaacccccacaaactgacgtggacttggggtcccaggcatctttcctcccagacccgagagcagccagaaacaaaccctccagaaacctgcctttcactggtacaaataaatcgacaaagagggca

SEQ ID NO: 48498 - DNA, 644 bp, Homo sapiens
cagggccactggggtctcccaggagcacctccagccctgccccccatgcccagattgtggggagcacagggctcgctccactgtccatggaagaggttggaaattcagcccagccatccccaccccagggacaggcctcccaggagctcacactcaacccccacaaactgacgtggacttggggtcccaggcatctttcctcccagacccgagagcagccagaaacaaaccctccagaaacctgcctttcactggtacaaataaatcgacaaagagggcaaatcctttctctttctggaggcctaatgtcagtgatacataattgcacatcacagtattttattattttgttgatatgaaatatttcagttgtttagttgtttttaactttcaaataaggatttgcatttcgttgagaagaaaagatgatttccaagacatggactattgccagatattctaaaccctattttggttaaattacagcacccagattttagtaacaaagcacattgattttatattcaaagcatttttatatttagtctcttaaccttttgtaattcccacccacagcttgcagtgcaggaaccctttttgtgtcccttgttgtcagtggggtgcctgcctgggcccaataattt

SEQ ID NO: 48499 - DNA, 268 bp, Homo sapiens
atatttattattattttagaaaaacagttgtagaagagacatcaattaatttgccggtcttgtccaatctccctttctaactgttctgcttgctagctcagcactatatgtgtgcttccgtaatgattgattggataaaaaatgggcacacgccttagggaaagctgattcatctgccagccagcaaccagcaggttaggagtcagacaggagctataagttcatgtactgttgatactgagttcccacacacatgcacactcacatg

SEQ ID NO: 48500 - DNA, 422 bp, Homo sapiens
ttaggttttaaccatgagattccctaaacacaatgaagtcgttatgcctgaaagaggaaaaggttctgacccacttttcattttaaaaacattaagaacttaaaaggaacaaagggaggggaaagacaagaagtacgatgccagcatcccttaaattattgtaaagtatgtttaggacatcatcaggagtctgcataaatttaattcaatttccaccatcgtccacactacaggatccacacagagtagctaatttaacatttgtttaccaaatattaatatatataaatttcaggctgggcacagtgtcacgcctgtaaccccagcactttgggaggccaaggcaggcagatcacttgagctcaggagcagcctggccaacatggcgaaaccccctctctacttaaaaaagaaaaaaaaaa

SEQ ID NO: 48501 - DNA, 264 bp, Homo sapiens
cacagctatttccatttctccacagcagagcgtttcccaccatcatctcagaatgcaatgagctgactgaatagtttacctagaatgagcttgctgagcaccagtaagtcaagcatcaaagttccagaggtgttgccagagccagatgatcaagcaggtattttactcaagttaggtctaagattgagtctgggagattagctaaggcatgaaaaaccccctaatcacatggggtctagagtctggacacccaaaagcaacatt

SEQ ID NO: 48502 - DNA, 221 bp, Homo sapiens
ataaactgtatttcccaggagtgttctaaatatccatgcaagaaaagactggggtttaatgagtccctgctttctgtaggtacagatgacatgtcaggctaattttggtcccttggggattatgaaggcctggaccttcccatgagcttggttcagggccttcccagcaggtcagagctcatgacatcaaacaaatcagagttgatacctgagcttttgag

SEQ ID NO: 48503 - DNA, 409 bp, Homo sapiens
ggcaggtcacagggtctctctgtgttgcccaggctggtctcaaattcctggcctcaagtgatcctcctcccttggcctcccactttcctactcttttagatttctgttgcagggctaaagaaatggacaacctttggataagagccaccaagccctaagtgatgttcagaaaggaaagcccagcagctacttaaatgggttcaggaacatttgggatttttctctcttgaagttcttttacagcttggggaactcccaagaggactgagacattgtcctgtttgcctctgcatttccagcgcctagaacagagctggtgcatacagaaggcaagcagctcagtgcatatttattgaatgaacaaacaaagccttctcaaagttcaggtttctttgccatgctttggggc

SEQ ID NO: 48504 - DNA, 653 bp, Homo sapiens
tcagctccaggactctgcagaccggcatcccttgtgagagggaagatgcttccatcaccagcctggggtggctctcctcctcaagccgggccccaaatgcactggcagctttatcccactttctacagcgatgggtctccaatcgttcctcaaatggagccttgccttcccccatccttgaagcattaatgagatagatgttttgtgcaggctctgctgagggggaggtcctgcttccccagatggaggtcagcccaccagagctgctgttctaaaattatcccctgcacatccctcaaaagcatcaaatggtcataataactcatatttacaaagcaccatcgcattcactgcatgggatcccacagggctttacaaacgcaacaaactaatacacacgctaactagaaggcgcctctcgccaatccctgcaaggcagccacctctggggtgaacggtagcagctgttgatctgcacggagccccaggacacaatggccaggccagggagggaagaatggccggactctgggaggccctacgctgccccaggccaacacactcagcctgtgttattctgatctgacagtgtcttttgattctgccgtctctctacctgttatccaaggattcacagctttgactgccgagcg

SEQ ID NO: 48505 - DNA, 459 bp, Homo sapiens
tgccttacggttctgggtaaagaattagggacatgatgcagtaaatgttaattaaatagtcttggcagaaaatgaccacaggtaatttcagtaagtatatcctaaataaataataaaatatgcagaaacgatttctaaggaaatttgagcacaaatgtttgctcattagaacactggaagggtcagtaatcagaactgtgtgcatatacaaatcacaggtctgggaagatcccataggtcgaaaatgtgtccttggacaaatggctcctctaataggctatctacgggggtgtggagcattaagagcaggtttactggagagacaaagataacaatagggtttgggaaaggcagaccctttaaaaaaggctgattttttgataagcagggaaaaagttatttaattttagtaatagtagtgaccctatataaagatcattatacagataatggaggctg

SEQ ID NO: 48506 - DNA, 323 bp, Homo sapiens
gcacctggcctgttccgggacagatcgcaaggctgagggttaagtaacacctggagtggttaggaggctgggcacctccttgtgaatctcccgggctgcgtggcgggtggcgggtggctggcaggggagggacccttggcactgctgtggctttgtatttgctgccagcggggcctttgatgccccaggggctgctcgcccagccaagggcattgtagaacacaaaagctgcagaaagcagcacaaataaagtgaaagcgacccaggaaactgccagggagcttatcagcctgtttcctgatcataggtatggggtgtaggga

SEQ ID NO: 48507 - DNA, 1000 bp, Homo sapiens
cggtttctagtcattttcactgccagcaggtgccctttctatgcataatagacttcacaagtgtaattaacacatgaggaccactgctgccagtttttcttcaggtacatgctgctaggagttttcaggacaacagtgtaggccataagagctttttacatggcgcctgaagatgaagtcttcgttgacttctggacaaagacatgttaaatggagctgagcccagaccctgctgttggtatcacaggtcacagtcattgagtccagaaaccccagaagctgtattgcagctttctgtggaccagaggccatgacagcaaagctctagtttgcatgcagttaataaatgaaaagtaggatactgaaaaccctaccattatgtggaggaccaattgcgcattcacaaatacgacatacaatcatctgagttaactttaattagagctataatcacagattttaattatctggaaaaaatcagtttagtacaaatgggctgccctaaatatttctcaaattatttttttttgtgtcccttcctatttttggagtggacaatagtgtggaaagtgcctaggttttggattcaggcagacctggattcaaatcttagtcttatctcttattaactatgtaaccattaaaaatctgttttaactctgtgatctgcaatatctttctgtaaaatgggtataacttacctactttgaaaagtggctatagcaattagagttattagtcaagtggcacctaggggccattagtaaatgatgattgcttttttcaccattattataaacatgggacatggattttggtttccagaaggtttaactcacattaagcattattcttacttctgttgccttgagagctcaggggaaaactttataattcatcttctctttttatccctcagattgtttttattttgattttttttttatttaacttgagttattgtatggttgttttcatttgcagctgtggcataagaatg

SEQ ID NO: 48508 - DNA, 441 bp, Homo sapiens
gcctgcctcggcctcccaaagtgctgggatcacaggtgtgagctactgcgcccggtttcctctttcttttaaatatcatacagtaaacaaggaatgatgggtccacaggaagagagaccaccatgtcttcagatctcctcacagccttgccctccagagtttagatgtggagggaatagattaaaggcaaacttcttgttttgctgtttatctttggacctgtcaggctgtaactgtgtgtttttctcctgtggtgtggggcactgcgtgagtttaagcaccaatcacatacatccacatgtacctgcacttctgttcccagaaggaagaccgtgagtgtgagttgtccaggtccttgatattttgaacaaataattgaacagaaagcacaaaggaatgaaaaacgggaaggaagcagcaaaagcaagaatttattaaagt

SEQ ID NO: 48509 - DNA, 401 bp, Homo sapiens
gggttaaaaactgactttacaactttactcaggatatacttttttagactatgttaataaaatgtgcatataaagaaggccaacaagtcacgattaaggtgaattctacctatgcgtcagttctagggatttgcatctgttgttttttgttgttgttgtttaagcaattgaagctgtatttaaggtaaccttttaaatagcttttagtttttgtttgagcatgtttttctatttaaggacccttatgcagagattatcaaaagaactacttttaggatataaactattttacaagtttaacagttaggaaatggcttcttttttgtttgtttgtttgtttgtttgtttgttttttgagatggagtctcactccagcgtgggggacagagcaagagtccgtc

SEQ ID NO: 48510 - DNA, 656 bp, Homo sapiens
tgcggggggcctggtttggggaaatttcctgactccccaagatgaatgagcatgatttctgtttttctgctttccacatggagccttttaataagctccacatgagttaagatattctcaaggaacttctgtctttgcaacaataaaagagacctaattaatataacctttttaataattgcacaacactgtactcattagctagcatatgaatttatgtgttgtgttaaaatggtccatttaacttatcgatttctacgactttagcctctaggcctggggttatgcatgttatccacatcttcagtgtagagacacaggaaattatccgtaacttttcgtcaaatgaatgaatgaaacagccactctaaaaaactacaaacacatgcactagtctttaatcatccctatttacagtgcttcatttgcataaaatagggtgcttaatatggcaaatacatgacacacatacacacacacacacatattttaataagagaagtgactgctccttctgctaactcagaaatgcaagacagaaagtttctctcaaatagctattttttctatgaagaatcattcagggtctctctcacttacataaaagcagggaaaatagactcattggaccaatgctatccccactcttcagcctc

SEQ ID NO: 48511 - DNA, 701 bp, Homo sapiens
caactagtatctataatattccagagataaattctgggtaattccaacataggtgaggaattagtatagagcagagagagatgagaatgtccagaactactattcttgaggatgagaaaggtgaacaattgtaagtttatgtaatttatggggaaaaataaaaatagagatcctaataagttaatggaacaactaacagaaacggaaaattgaatgtataactttgaaacatactacgtcagttaggaaaggcttgctggcaggtaagaaaaatctgcaaattagcgtattaagcaagatggaggcttacatctttctgaaaagaatttctgacgtaggcagtcaatccattgctgacgtagcagctccatggcaatattaaacccagctgacctaccccttcctttttaggacatttctcagatatcatacatcaaacctcctttgtatctcattggctaatcatatgacaatacctggctttcaggaaggctgggatgtactgtatagcaggactgcatcatgtccagctaaaaactggggttctcaaactaaggaaggaggggaaaatagctagcaggaggcgactagcaaactgccacacctgcaaaaggaaaattaatggaaggcaaaaatgaaggggggaaaaaataagaagtatggtaattagaaagcatgttagaacatgtggaaaaaggggg

SEQ ID NO: 48512 - DNA, 929 bp, Homo sapiens
caactagtatctataatattccagagataaattctgggtaattccaacataggtgaggaattagtatagagcagagagagatgagaatgtccagaactactattcttgaggatgagaaaggtgaacaattgtaagtttatgtaatttatggggaaaaataaaaatagagatcctaataagttaatggaacaactaacagaaacggaaaattgaatgtataactttgaaacatactacgtcagttaggaaaggcttgctggcaggtaagaaaaatctgcaaattagcgtattaagcaagatggaggcttacatctttctgaaaagaatttctgacgtaggcagtcaatccattgctgacgtagcagctccatggcaatattaaacccagctgacctaccccttcctttttaggacatttctcagatatcatacatcaaacctcctttgtatctcattggctaatcatatgacaatacctggctttcaggaaggctgggatgtactgtatagcaggactgcatcatgtccagctaaaaactggggttctcaaactaaggaaggaggggaaaatagctagcaggaggcgactagcaaactgccacacctgcaaaaggaaaattaatggaaggcaaaaataaaaaaaaaaaaaaaaaaaagggggttcttttcggcgcggccaaccagggacgaaggctcatgtcaaaagtggggcgggcctcttctcggccaggggttaaccccgggccccaaggggtgataaacgaaacatacgtggatcgcacacgaaacacaattccaccacacacatccaacaacaaaacacaccacacaccgcacccccaacccacccaacagaacaacataacaaacaccacccacaaaccaccgcacaccacaccaacacaacacccaacacacacagcaccccc

SEQ ID NO: 48513 - DNA, 303 bp, Homo sapiens
gacaaacctcagtgacttctgggtcgcacattcttgcctgggaagaccctgttcttacctggtaaggcacaattgaaactatgattggtccacttcacagacgaggcagcttgttttctcccctggtgtgttattagttttaatggacatatttgtgcaatcagtgtgtacagttcatgttggtaagcatctggcatattttcattattttagaataatgctatgctgagctcacatttcagcttcttgtcaaaaatagtaatattctggtatggcagatttccttctggggcagtacttccc

SEQ ID NO: 48514 - DNA, 471 bp, Homo sapiens
tcccagtcactcaggagtctgcggcaggaagatcacttgagcccaggagctcgaggctaaagtgagccacgattgtaccactgcactccagcctgggcaacagagcaagaccctgtctcaataaataaataataaataaataaataaaggcacaaagatttcccatatactccctaccccaccccccccccacccccacacatacacaacctctctccgtagatttgttgttaatgtttgtctgcataggttgtacctctggtatgtaatttttgttttaatcgtttgtaacaagttaatttgtttttaaacaggcaacctgcacttccccaaccccagaaagtgctgataatgaagagtttatttgctcccaaaacaaagctaagttttcatctcaccagtgggagtattaccctctgtgtttttaggtcattaaatatttgcaataaaaaatacaattaataatttagt

SEQ ID NO: 48515 - DNA, 2556 bp, Homo sapiens
  misc_feature (2046)..(2046): n is a, c, g, or t
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggtgagtggactgcgcctggcttcccgaagtggagaagagggctggttgaaacctgctgtggcgcgactcgggcctccacgccatcggctccggaacctgcggaccgagtcgccgtggcgtagccggggctcagtcctcttctgttcagggccgggccgggcggggcgggcagcggaacccctgcatcctgtctgtacctgcgggcgccacttccgccggccggatccctgtcgggaacccctcgcctcccctatccaggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcgggcgcctgtggtcccagttactcggggggctgaggcaggagaatggcatgaacccgggaggcggaacttgcggtgagccgagatcgcaccactgcacttcagcctgggtgacagagtgagactctgtctcaaaaaataagataaaataaaataaaaaaataattagctgggcatggtggcacattgcagttgtcttagttgtttttcaaggacatgaaaagccgtgcgcaaggcggnggaagccctgtgcatgcagatcacgaggtcgggagattgagaccatcctggccaacatggtgaaacctcgtctctactaaaaacacaaaaattactgggattacaggcgcccaccactatgtccagctaattttttgtatttttagtagagacagggtttcaccatgttggctaggctggtcttgaactcctgacctcatgatttgccccccctcagcctcccaaagtgctgggattacaggcatgagccactgtgcccagcggagtaagtttaatttgtatgtattgttctgtgattaatggaccagtgagtaatgattgctaattgttgcgattttcttactagcctcacttggcaaattttggttatcccttgtccattatacacattccacctttttttattaaaggaaaaactactcttggtgtaaagatgtttattttttgctaataatgagttggtattaattcctaagtacataaagtttatcatagagtatcatctcgtga

SEQ ID NO: 48516 - DNA, 2237 bp, Homo sapiens
  misc_feature (1727)..(1727): n is a, c, g, or t
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcgggcgcctgtggtcccagttactcggggggctgaggcaggagaatggcatgaacccgggaggcggaacttgcggtgagccgagatcgcaccactgcacttcagcctgggtgacagagtgagactctgtctcaaaaaataagataaaataaaataaaaaaataattagctgggcatggtggcacattgcagttgtcttagttgtttttcaaggacatgaaaagccgtgcgcaaggcggnggaagccctgtgcatgcagatcacgaggtcgggagattgagaccatcctggccaacatggtgaaacctcgtctctactaaaaacacaaaaattactgggattacaggcgcccaccactatgtccagctaattttttgtatttttagtagagacagggtttcaccatgttggctaggctggtcttgaactcctgacctcatgatttgccccccctcagcctcccaaagtgctgggattacaggcatgagccactgtgcccagcggagtaagtttaatttgtatgtattgttctgtgattaatggaccagtgagtaatgattgctaattgttgcgattttcttactagcctcacttggcaaattttggttatcccttgtccattatacacattccacctttttttattaaaggaaaaactactcttggtgtaaagatgtttattttttgctaataatgagttggtattaattcctaagtacataaagtttatcatagagtatcatctcgtga

SEQ ID NO: 48517 - DNA, 2298 bp, Homo sapiens
  misc_feature (1788)..(1788): n is a, c, g, or t
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcgggcgcctgtggtcccagttactcggggggctgaggcaggagaatggcatgaacccgggaggcggaacttgcggtgagccgagatcgcaccactgcacttcagcctgggtgacagagtgagactctgtctcaaaaaataagataaaataaaataaaaaaataattagctgggcatggtggcacattgcagttgtcttagttgtttttcaaggacatgaaaagccgtgcgcaaggcggnggaagccctgtgcatgcagatcacgaggtcgggagattgagaccatcctggccaacatggtgaaacctcgtctctactaaaaacacaaaaattactgggattacaggcgcccaccactatgtccagctaattttttgtatttttagtagagacagggtttcaccatgttggctaggctggtcttgaactcctgacctcatgatttgccccccctcagcctcccaaagtgctgggattacaggcatgagccactgtgcccagcggagtaagtttaatttgtatgtattgttctgtgattaatggaccagtgagtaatgattgctaattgttgcgattttcttactagcctcacttggcaaattttggttatcccttgtccattatacacattccacctttttttattaaaggaaaaactactcttggtgtaaagatgtttattttttgctaataatgagttggtattaattcctaagtacataaagtttatcatagagtatcatctcgtga

SEQ ID NO: 48518 - DNA, 345 bp, Homo sapiens
agacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagt

SEQ ID NO: 48519 - DNA, 361 bp, Homo sapiens
attcatggaaatgctctgccagaggctcgggaatctctgcagagaacattttctgtactgcaggatgacagaggctgtcgagaataaaatgaagctgagtgcttgtggttgggattccttctttttcctcttttattgtttctccttagctttgtgcccaggtcatttgtctatcttccttcccttgaaatccctcctgctttggggccctgcactgcctctggagcatccagttctgagattccaatcacagggccaggcatgaaacacggccatccctcaggcacacggctgctgggatatggcaagcttgttaacacggcaggacaacccaagatgccatgttcctaaagaaaatggg

SEQ ID NO: 48520 - DNA, 222 bp, Homo sapiens
tatcccacacaaggacttattctagaggctgcctttgagttgaaaccccagtgaaacacagtgggaagggctggcttgcttggtggcagctcagaggtcccccaggtttgaaaggctcatgccaccctcttcccctgctctgggaccttcccagtggtgaaaagggaaggcagcagaaagagaatgctcccctttctgtcaaggccgaaagtgtccacctgg

SEQ ID NO: 48521 - DNA, 1714 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48522 - DNA, 2521 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttcgtgcagcatgtggtgtctcagaactgtgacgggctccacctgaggagtgggctgccgcgcacggccatctccgagctccacgggaacatgtacattgaagtgagcagtcctgcagggacccagggtctccatgggcaggcgggtcccactcactgtgccctcttgcctctaggtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48523 - DNA, 836 bp, Homo sapiens
taggtagagccggtgttagtttcatcgtgacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggcaaaacaaaaaaaaaaa

SEQ ID NO: 48524 - DNA, 1641 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48525 - DNA, 1550 bp, Homo sapiens
cgcgtgcgcgcgcgggcgcccccggtttcgggagcagctggggcgacgggcggtcccgggtggggcggcccggggcggtgaccaccctggcgtcttggcaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48526 - DNA, 2690 bp, Homo sapiens
ggtcgctagagcaaactcagacacacactctgcgctcttggagttgggaaacccacctgcgttggctttttgtgggaggtggccttgattgggccttgaaggatgggtgagatttacagaaggttggaatgaggcactccaagcaaagaacagcagaggctcagcagcaagaatgcaaaaagggagttcactactgactcaaatacccggagccctggggtttagtctcctccctccacaagtcacatgtaaaagtccagtcatgctgggcgcggtggctcatgcctataatcctagcactttgggaggccgaggtgggcggatcatgaggtcagtagttcaagaacaacctggccaacacggtgaaaccctgtctctactaaaaatacaaaaattagtcgggcatggtggtgggcacctgcaatcccagctactcgagaggctgaggcaggagaatcacttgaaactggaaggcggaggttgcagtgagccgagatcatgccactgcattccagcctgggcgaaagagctaaactccgtctctcaaaaaaaaaaaaaaaaaaaaaagtccagtcatgtaattatgtaacagtcacgtgacctgttatggaacttccaatggcaactaaaagcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48527 - DNA, 2080 bp, Homo sapiens
  misc_feature (7)..(7): n is a, c, g, or t
ggattantaagaggtggtgtctcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48528 - DNA, 1730 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggcaaaacaaaaaaaaaaa

SEQ ID NO: 48529 - DNA, 1777 bp, Homo sapiens
  misc_feature (403)..(403): n is a, c, g, or t
gtgggtgttgagtcctgctcctgagctgcaaatgcggtggagctgggtccggaggttgcgggatgtgagcagcagagtgtgatgctgcctccgccagtgtgtctgcatgcatccttgagtgaatgtgctgtgctgtgctgtgatgctgcatgctgcctgatgtgatgtgtgcctggcttgcttggcctgatgatgctgctgtgaccttggtaactgtgatgcttgcatgtgtgcctggatgcctgtgctgtgctgctgatgtgtgccttgaatgctgtgctgtgcatgtgatgtgatgtgttgttgctgatctgaaccctgtgatgtgaatgcttgctgtgtggtgaatgtgtcctgtgtgagcttgtgccatgctgcctgtcctggaacgccaaatacttgngtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48530 - DNA, 3351 bp, Homo sapiens
ggtcgctagagcaaactcagacacacactctgcgctcttggagttgggaaacccacctgcgttggctttttgtgggaggtggccttgattgggccttgaaggatgggtgagatttacagaaggttggaatgaggcactccaagcaaagaacagcagaggctcagcagcaagaatgcaaaaagggagttcactactgactcaaatacccggagccctggggtttagtctcctccctccacaagtcacatgtaaaagtccagtcatgctgggcgcggtggctcatgcctataatcctagcactttgggaggccgaggtgggcggatcatgaggtcagtagttcaagaacaacctggccaacacggtgaaaccctgtctctactaaaaatacaaaaattagtcgggcatggtggtgggcacctgcaatcccagctactcgagaggctgaggcaggagaatcacttgaaactggaaggcggaggttgcagtgagccgagatcatgccactgcattccagcctgggcgaaagagctaaactccgtctctcaaaaaaaaaaaaaaaaaaaaaagtccagtcatgtaattatgtaacagtcacgtgacctgttatggaacttccaatggcaactaaaagcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttcgtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48531 - DNA, 3325 bp, Homo sapiens
ggtcgctagagcaaactcagacacacactctgcgctcttggagttgggaaacccacctgcgttggctttttgtgggaggtggccttgattgggccttgaaggatgggtgagatttacagaaggttggaatgaggcactccaagcaaagaacagcagaggctcagcagcaagaatgcaaaaagggagttcactactgactcaaatacccggagccctggggtttagtctcctccctccacaagtcacatgtaaaagtccagtcatgctgggcgcggtggctcatgcctataatcctagcactttgggaggccgaggtgggcggatcatgaggtcagtagttcaagaacaacctggccaacacggtgaaaccctgtctctactaaaaatacaaaaattagtcgggcatggtggtgggcacctgcaatcccagctactcgagaggctgaggcaggagaatcacttgaaactggaaggcggaggttgcagtgagccgagatcatgccactgcattccagcctgggcgaaagagctaaactccgtctctcaaaaaaaaaaaaaaaaaaaaaagtccagtcatgtaattatgtaacagtcacgtgacctgttatggaacttccaatggcaactaaaagcacatgcagctagtggatttcatcggagtgtttgaggttcccgtcttgaatgtgactgtcggaactactgtccgggggggtggtgcatttttctgagtttaagcaggagtcgggagtccccaaaagggaacacaagacaccttgatcctggcatatcttgtgtgccctctgtgggcctcagtttgtttcacaggattgaaaacctgggaagttagatgctcatctcatctgaagaagttgttctgcctttgttaaggtggagcgggaatagtcagcactgggacatgagaatggacagtcgcctggacccacctagggattcaccatttgctaaatgtgtgagctgtgggctcggccctgggggcactttaggaacatgactagtcttcccctgcagtgtggaggacacatgtgccacagagcccagctttgtgctcggtgccagagaggcttccggaggcaggcagggctgcgtgcagcctggaaggatgagccaggccaggcgggaaacggaagtccaggtagaagggaggagccgaattggggtacactccatatgggctcaggcaggtcagcctgtggaatgaatagaggccaacatgcaggccagcccggaatgcggcaggagtgacagtggctttccgtttctgggaattctgccagtacctacagtggtgccttttgacttggcttaccttttttctcgacatgcaggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttcgtgcagcatgtggtgtctcagaactgtgacgggctccacctgaggagtgggctgccgcgcacggccatctccgagctccacgggaacatgtacattgaaggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48532 - DNA, 1714 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtgagcagtcctgcagggacccagggtctccatgggcaggcgggtcccactcactgtgccctcttgcctctaggtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48533 - DNA, 1228 bp, Homo sapiens
gttgttctagaggatcccagactcggcagtgcagcatgtggtgtctcagaactgtgacgggctccacctgaggagtgggctgccgcgcacggccatctccgagctccacgggaacatgtacattgaagtgagcagtcctgcagggacccagggtctccatgggcaggcgggtcccactcactgtgccctcttgcctctaggtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48534 - DNA, 1803 bp, Homo sapiens
cgcgtgcgcgcgcgggcgcccccggtttcgggagcagctggggcgacgggcggtcccgggtggggcggcccggggcggtgaccaccctggcgtcttggcaggtgtgcgacgacccggaggagctgcgggggaaggtccgggagctggccagcgccgtccggaacgccaaatacttggtcgtctacacaggcgcgggaatcagcacggtagggagggaggcggaggcgtaccccaggacggagtatgagctccagtaatcgcgaaaaactcgcctttaaagcagctctaaggttttttctcttaaagaaacgaaatgaccaaaacttacctaaggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggtacgtgccgatgacacaatgagtgaaccgagcccctgcctgcccgagggtgtccagctctgcggcccagcactgtacagacttgtcccttgtgtgtgtgcggtgtctgtctgtctgcttccacaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48535 - DNA, 1356 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgagcctcggctctatgcagacctttttatttctattaaacgtttctgcactggcaaaaaaaa

SEQ ID NO: 48536 - DNA, 717 bp, Homo sapiens
ggctcccaggcccgcctgatgccgctttccctttttggcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48537 - DNA, 1361 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggtacgtgccgatgacacaatgagtgaaccgagcccctgcctgcccgagggtgtccagctctgcggcccagcactgtacagacttgtcccttgtgtgtgtgcggtgtctgtctgtctgcttccacaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtgagtgagccgctgcagcagcctgcttccccgcacctctgtgtgctgggccttgtctgtcttctctcgtgagctgagtgtggaggaagctctgaggtgtttgcagtggtgcctgaggcatgactgaagcgtggtggtctccagagggcctgacctcggtggttggcggagaccctgcgtgtgccactcctgccctg

SEQ ID NO: 48538 - DNA, 269 bp, Homo sapiens
gtaagcgggccaggcatggcctcccacataggctgggcagcggcagcacgggcctgagctccagctctcctcaccttgccttcctttctgcctggcagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagtt

SEQ ID NO: 48539 - DNA, 1417 bp, Homo sapiens
  misc_feature (43)..(43): n is a, c, g, or t
ccccggagggggtgttttaaatcggacgaggggcaatacttgngtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48540 - DNA, 2446 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtacgccgccgccgctccccggcccggccattgccggcccgcgccgccgctcaccgtccgcctgcccgcaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtaagagccctgggtggctggtacacttgccagggaccaggcagagcaccttggtgcccagtgggcaactaactgcacccgccctctgtctgccagttgactcccatgatgagcacccaccaagcgggttaggccgcgggtttgatcctcctgtgcttgactctccaggacagaaggggagctccccctctgaaccatcccatccgcagccagcctcagcctcagagctgctggtggcctttcccctttgtgattcccttgcatttttctgtggacctcagaagccatcctagtcacaggggaggcttataggacatctctggggaccttctgctgaacaccctcaaccaatggggtgtagtggttgatctgcctaggtccccagggacctgaaatgtcatgacccaagagagcatggatctggggcagagtggcccttgccaaaccccgagccacttcccaaccttgccgggacggtgcaacctcttgccctcccagccactccaggtgcatcagggctggaggaaggacagcccctccccaccacaggccctcttgactcctggtggttggacctgttgtgtgttttactttctaaggctctctggggggacggagctgcccctggttttgggagccatcggcggggctcagaacagcctcgctgtggccgggtactgacctccccaccaccactggcagccatccctccccttgccacccgttctgccttcgtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgacattttcaccgtgacatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48541 - DNA, 1584 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48542 - DNA, 1558 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48543 - DNA, 1235 bp, Homo sapiens
ggcggaagcggaagagcaggtctccaggggagcgatggcagccgggggtctgagccgctccgagcgcaaagcggcggagcgggtccggaggttgcgggaggagcagcagagggagcgcctccgccaggtgtcgcgcatcctgaggaaggcggcggcggagcgcagcgccgaggagggccggctgctggccgagagcgcggacctggtaacggagctgcagggccggagccggcggcgcgagggcctgaagcggcggcaggaggaggtgtgcgacgacccggaggagctgcgggggaaggtccgggagctggccagcgccgtccggaacgccaaatacttggtcgtctacacaggcgcgggaatcagcacggcagcgtctatcccagactaccggggccctaatggagtgtggacactgcttcagaaagggagaagcgttagtgctgccgacctgagcgaggccgagccaaccctcacccacatgagcatcacccgtctgcatgagcagaagctggtgcagcatgtggtgtctcagaactgtgacgggctccacctgaggagtgggctgccgcgcacggccatctccgagctccacgggaacatgtacattgaagtctgtacctcctgcgttcccaacagggagtacgtgcgggtgttcgatgtgacggagcgcactgccctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtgagtgagccgctgcagcagcctgcttccccgcacctctgtgtgctgggccttgtctgtcttctctcgtgagctgagtgtggaggaagctctgaggtgtttgcagtggtgcctgaggcatgactgaagcgtggtggtctccagagggcctgacctcggtggttggcggagaccctgcgtgtgccactcctgccctg

SEQ ID NO: 48544 - DNA, 729 bp, Homo sapiens
cgtaggggccaaggctgacaggccaccgggaagggttgggctgctgttactctcactcggctttccctgtcctcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaatttttagccatttgtccttgaggaagccccttgcactgctgcggttgtaccctgatacggcctggccatcgaggacacctgcccatccggcctctgtgtcaagaggtggcagccgcacctttctgtgagaacggaactcgggttatttcagccccggcctgcagagtggaagcgcccagcggcctttcctcgctcaccaggccagtctcagggcctcaccgtatttctactactacttaatgaaaaagtgtgaactttatagaatcctctctgtactggatgtgcggcagaggggtggctccgagcctcggctctatgcagacctttttatttctattaaacgtttctgcactggc

SEQ ID NO: 48545 - DNA, 379 bp, Homo sapiens
tttaaaatagctctacacatagttaacatttaccttttttaggttttcagatttgactttctgctggtcatcttttcaaagaaaatgaaacgtttaaaagttcatctgataatactgctaccatagttttgttttcactgctcatctcttattaaggtttttaaccataaaactgaagcaatttctgtaaagacacaaattgataacttagtatagaattaaaattcattaagttatcataagtttgatgatatccttgttaatgtactgatttttgaattattttatttgccataatccatatatttctaacatgagtattttgacagtatttaataaatcagaaagctgtttgaatggaagtaaactaaaaaaaaaa

SEQ ID NO: 48546 - DNA, 510 bp, Homo sapiens
tcatctgatgctgatttccattttttaggaaattgtaaatatttatccatctatcaacccacccaccttgacagcacaccagtctaacagagtttgcaatgctctggcattactgcaatgtgtagcatcacatccagaaaccaggtaaatgctttgggtgagtcacttgggggagatatacattgaatatggtcctaaacgttctctctctctctctctctctctctctctcctggtcttccggattcttatttacttttacccaatgaactttaaagaaacagtgttcacattacaggaaaggtatcaggcatacagctacttctcactccctgacctgttattgacactatgtcatctgtgaggcatagtgcatggcatataagaggagtttagtaattatttttccagcacttttcccacactgaacccagatttgacttcagaatccttcttaacatagcattctgggcggcctctataatagacgagaattggcatgtaagttaa

SEQ ID NO: 48547 - DNA, 1879 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattaca

SEQ ID NO: 48548 - DNA, 2138 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaaaaaaaatgtc

SEQ ID NO: 48549 - DNA, 1435 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggttttcagatttgactttctgctggtcatcttttcaaagaaaatgaaacgtttaaaagttcatctgataatactgctaccatagttttgttttcactgctcatctcttattaaggtttttaaccataaaactgaagcaatttctgtaaagacacaaattgataacttagtatagaattaaaattcattaagttatcataagtttgatgatatccttgttaatgtactgatttttgaattattttatttgccataatccatatatttctaacatgagtattttgacagtatttaataaatcagaaagctgtttgaatggaagtaaactaaaaaaaaaa

SEQ ID NO: 48550 - DNA, 1114 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggtaaacatttatagga

SEQ ID NO: 48551 - DNA, 1871 bp, Homo sapiens
tagcaaagtccggacatgtacattggaatacatatataacaacattcaggacaacactgttcaaaagagcaaaaacctactcaaaatccaaaaatccactgacagaagaatagaaaattctaattgtggtatattctgaatccctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggtgattgtgatgcaagtgatctaagaactacgctttgacgaacaccgctttaggagtactgtaagataaatctacatgacagggggaggaaggtggaaagtagagtataaggaccacaaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattaca

SEQ ID NO: 48552 - DNA, 1266 bp, Homo sapiens
gcctggcgacggctgcgtctgtgcctactacactggcattactgcagatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattaca

SEQ ID NO: 48553 - DNA, 1338 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattaca

SEQ ID NO: 48554 - DNA, 1219 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggtaagttattagaattgttttgcaagcctgaaatactcacagtagtagtctaagttgggtgttttgtcttgccggttatgatttttgtacaccagtcattcatttttgtctttgaggttgtctcattcactaatcaataagtatcaggaacatgatgactcctatcaagcactcttctaagtgttgttaataagactttgagatccaacgtttgggattaaattcagcatatatgtggaaacatttgctggaattgtagggagagtaaagcataagaacttgattcaatatataaagagtattattaaaggaataagagtttaaatttgggacttctcctcttcccttttctctcctcttctcttcttttcttttcttttctttctgatagggtcttgctgtgttacgccaggctggaattg

SEQ ID NO: 48555 - DNA, 630 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccgtcgacgcggccgcgaatttgta

SEQ ID NO: 48556 - DNA, 934 bp, Homo sapiens
tgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattattttccgctgcaggggtgctgaaggggggacgcgggtcggacgcgtccggctgtggaagagagcggcggccgctcacaacatgcacagcctggcgacggctgcggtgagtggctgggcccccaggcttggaaccagaatcctttctcagacccacgtttcggccttctctcctaattcccggtgtcgggtccctagtctgatttttttctgccctcaatctccaaggccccggttcccctcctcggcacgctttggttgtggtggagccggcccctatttccttgccggacgcctctcgcggccttcagcgcgacccatcgcgttctttgcgggcgccggggcctggtcccacgcccgtagcaggccattcattgatttattgcgctgaccaacagtttcagggcgccagttgtgttctgggcgccggcgtcgatgaggggaattccatggtcaatctgacgcggcccctgctcttagaactcaccacgtcgcagcgggaaggaaatggcttctagttcaaaccacttgctttatttatggaaaacctgaggcccggaaaagtgcataatttttgcatctgacttaggttctctgcatttaaaacttttcctcgacacatctcgttttacccgcgtgatcttttaac

SEQ ID NO: 48557 - DNA, 379 bp, Homo sapiens
cttagtgaattaatgaacatcctggagataaaccttgataatcctattggtgaataacatctaagtcatccagtagataatgtttcttctgaaaggttatgtgaccaaccagaccctacagattttgagaaaacatcctcctcataattgcactttgttttagccatgaagtccaatatgcaatagaaatagaaaaacaaaaatttcagaaagaataccagtgaaatcaggttatacggcagtatgttagcttcgtgttcctactgtgcttaagggaagcattaatttcctcaataatttttctccttggcttagtgctgaaatggcacaaaataggtggaggtctgattctgatttactattaatgccacaagcattt

SEQ ID NO: 48558 - DNA, 719 bp, Homo sapiens
atataatagtgcttaataaatggctaatttagaaagacttgagattgaggactggccaacagggtcaaaatgcaaggcctgccgatgtccaggatgtaccaggtgtctaccttcaaggatcatttggaggaaggaggtcatgatgaaagatgaagtgagtgacctccaagttggatgacctccatcaaacaagatgggcaaattcccaaatgctactggtcacaggtgcctgaggagaacaatctgctttcaaagtacaattaaatatggaaaatgctcagtgatctcaaggggtagacccaccccggtgccccatctgctcagtttaggcagagccattagacagtgctggggaaaatgtttatctctaagtttacagaaggttcttttggaatctctttgccgaactcaaaaggggggcgttctcagacacagatgatctcaacaacctttgtttaggttggaatcctgggaaagtcatcaatctttgggcaactcacatttctatttttgttccagttatccagcagataataaataagtttttagttctgctaagtgctaatttgagaggcatctctttttatttattgggagaaaatacgaaagatgcagcctaagaaataatctgttggtgttgccgactcaccttttcaggtaaggcatccattttattattatttagcatttttgctaaattaagaatgagaatgaatcag

SEQ ID NO: 48559 - DNA, 316 bp, Homo sapiens
gattaaaatcactcagtaaactagtacagcgtgataattcccaatccaaaaacctgaaatgctccaaaatcctaaactttttgaacaccaacatggagtgcaagggaaatgctcattgtagtgtttaggatttcagattagagatactaaactggtgtaatgcaaataattcaaaatttaaaaaaatcgaaaattggaaacatttctggttctaagcatttcacataagagctactcaacctgtactaaaaggtaattattatttttcattctgataagggacacctacgaaaactctacagcaaactatatgtta

SEQ ID NO: 48560 - DNA, 441 bp, Homo sapiens
atatctagtagcagccatttttcaggattaaagtacagtttatcaaaatttacccaatcaactcccattttatttagctatgataaatgttccatgctcttacagccagaaagtatctgattattaactcaagtaaacttgaattcatttgctgcagccaaactgctgctctgggataggatgtgaccaaagtttgtactttattttaacctctagggattggagagaaaggaccagtgggatgatgagaagtcttggattctggaggccattttagccatttattcattattatgtgactttgggcaagtcttgtgatctttttgaagttccgtttcatatccattacaaatgaataacagttgtcacgccacacagagttatggtaacagtgaactaatttcgaagacactgtgaaaaacacaaagctcactgacttgg

SEQ ID NO: 48561 - DNA, 715 bp, Homo sapiens
tgtgccatctagcaggggatttatcttgatttcttcaaagttcttttccttttgggatatttgggtcagtaaaaggcccacacattttctgaaagcaaaatggaaaacatttttgaaaaaaaatttaactttttgttagatttaagagataattgcaaaaaagaaatcttatttatttatttatttatttatttatttattcatttattttggtagagacagggtcttgttatattgcccaggctggtctcttaactcctggcctcaagctatcctccggcctatgtctcacagagtgctgggattacaggtgtgagccactgtgcttggcctgggaaatcttattgtaattattgatgaaaaccctgtgtggacaggaactttcagctatttataaataacttcagctgtttttaaataaaaacaacatagttcttgcccagattgttgtttctggcacaatgggcttttactagctgttttcattgaagctaagcagggaaataatcctatatgtattccttagaccaatgaaagctatagactgtggctattttgtaaccttagtgctaaaattagctaccaaaataattgctacatcatcttttctgttatgatgaaccaggctggtttcggaccagtatttttgttgttgacatagtgatttggattgtatttcagctgtctcaaaaaatcatagttttagaaaattata

SEQ ID NO: 48562 - DNA, 444 bp, Homo sapiens
ccaggatcatggacacaggacatgggtaagttcctgaactccctctctgccctaaggttccttcatcctatcaaatgaaagtagtaatagtgagtattcactgaacacttccctatttggctgcactttttaatgtgtttcatattatgatgtgcccaggcagagctctgtaataagtcagtgcttctcaaactctctgtggtaaatgattaccttttttcttgaatttccaatttgccacagatcaatatttctgcaaagtactttaaaagttacttcctatgagcttttacagtgacaaatgaaaattttaaaaaaaaccttaaaattgaaatcactgtacaaattagttattggttataaattactacaaacacttcaataaatatttaacaaataaaaaaataaaaaacttaattcctagaaaatgacataaaaaaaaga

SEQ ID NO: 48563 - DNA, 2759 bp, Homo sapiens
cccaagtagctaggaccacagacacctgctaacataccctgctaatgtttttaaaaaatttttctagaggtggctataacttttaatttttttgttttttgaggtggagtcttgctctgttgcccaggcccaccatgccaggctaatttttctatttttaatagagaccagttttcactatgtaggccaggctggtctttaactcctgacctcaagtggtccaccctactactctacatgcctgctctgttattaaccaagttttcatatgaatactggcccattgaagactcttctttttccttgatctatttgtttatctctctgctaatagtatgctgtcctgaatgtgatggtttggaaatctttggtgttaggtaagccatccacctgctattcagaaggctttgacaattattagatgttaattcctgcacaccaggtggtgggaggtttggaaaagtagcttttgtttacctaaaatgtctgttttggggatttttttttttttttgagacggcgtctcgctctgttgcccaggctggagtgcagtggcatgatctcagctgactgtaatctccgcttcctgggttcaagtgattcttctgtctcagcctcccaaatagctgggactacaggcatgcgccatcacgcctggctaattttttgtatttttagtagagatggggtttcaccatgttggccaggctggtctcaaactcctgtcctcaagtgatccacctgcctcggcctcccaaagtgctgggattacaggtgtgagtcaccacacccagctgtattgggtatttatgaaattttgtaaggatatcatttggaagaagggacatcttattgagttttttctaggaacacatgttatctttccacttactccatactgctttgacattacctgacagaaattttaaaattcttccattaggacaattaaatattgatcatgaatcttatttactacttgattaaatttggtctagagtaaactgcttgcaagcttcaggatattctctcttggtataaccacatgggatgagctcagttccccaggggacaagttgtgacaacacgtgtgacatattgtctcccaggaaagctcattaaagactctgtgcccagagtgtttttctggggctagtgccctaggcaccacttctagtttggaacaaaagagtaggctttcagaaggaaaacagttcagtcagtaccatcctgtttgtcaataccataaaccgtttagccacagtaagccactttgtcacttaagttgatgggatccctctcgtagtctaagttgaccccgatagtagcaaaggtcgaacttggtaaacaggcctttctaaggatacccagactcaggactgctgaaatgagcgctgtctgcacaccaggtggtgggagtttgttgtgacaggtactagagattcactctgcaaagagcatttggggcaacgcagcagcacaactgactccctggacccaccacagagagggtggtcctcctctgtggctggctctctgagtaggtcagttctcacactggaactgctgcgagggaggaagtgcgtgtagataggaggaggccgatgactcaatcatggagtgagtgtttggagagcccggcgtcatgggatcactcatgtattgagtagagatccccagtgctgagtctcacccctcctcctccacacctgtgggatgtttcaggactcagtggcctttgaggatgtggctgtgaacttcacccaggaggagtgggctttgctgagtccttcccagaagaatctctacagagatgtgacgctggaaaccttcaggaacctggcctcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttc

SEQ ID NO: 48564 - DNA, 1969 bp, Homo sapiens
  misc_feature (1785)..(1785): n is a, c, g, or t
gagctgtaaggtcagccgaaaggacgaagagacctgaagtcagtcaagactcagtggcctttgaggatgtggctgtgaacttcacccaggaggagtgggctttgctgagtccttcccagaagaatctctacagagatgtgacgctggaaaccttcaggaacctggcctcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccancatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctc

SEQ ID NO: 48565 - DNA, 3647 bp, Homo sapiens
  misc_feature (3463)..(3463): n is a, c, g, or t
cccaagtagctaggaccacagacacctgctaacataccctgctaatgtttttaaaaaatttttctagaggtggctataacttttaatttttttgttttttgaggtggagtcttgctctgttgcccaggcccaccatgccaggctaatttttctatttttaatagagaccagttttcactatgtaggccaggctggtctttaactcctgacctcaagtggtccaccctactactctacatgcctgctctgttattaaccaagttttcatatgaatactggcccattgaagactcttctttttccttgatctatttgtttatctctctgctaatagtatgctgtcctgaatgtgatggtttggaaatctttggtgttaggtaagccatccacctgctattcagaaggctttgacaattattagatgttaattcctgcacaccaggtggtgggaggtttggaaaagtagcttttgtttacctaaaatgtctgttttggggatttttttttttttttgagacggcgtctcgctctgttgcccaggctggagtgcagtggcatgatctcagctgactgtaatctccgcttcctgggttcaagtgattcttctgtctcagcctcccaaatagctgggactacaggcatgcgccatcacgcctggctaattttttgtatttttagtagagatggggtttcaccatgttggccaggctggtctcaaactcctgtcctcaagtgatccacctgcctcggcctcccaaagtgctgggattacaggtgtgagtcaccacacccagctgtattgggtatttatgaaattttgtaaggatatcatttggaagaagggacatcttattgagttttttctaggaacacatgttatctttccacttactccatactgctttgacattacctgacagaaattttaaaattcttccattaggacaattaaatattgatcatgaatcttatttactacttgattaaatttggtctagagtaaactgcttgcaagcttcaggatattctctcttggtataaccacatgggatgagctcagttccccaggggacaagttgtgacaacacgtgtgacatattgtctcccaggaaagctcattaaagactctgtgcccagagtgtttttctggggctagtgccctaggcaccacttctagtttggaacaaaagagtaggctttcagaaggaaaacagttcagtcagtaccatcctgtttgtcaataccataaaccgtttagccacagtaagccactttgtcacttaagttgatgggatccctctcgtagtctaagttgaccccgatagtagcaaaggtcgaacttggtaaacaggcctttctaaggatacccagactcaggactgctgaaatgagcgctgtctgcacaccaggtggtgggagtttgttgtgacaggtactagagattcactctgcaaagagcatttggggcaacgcagcagcacaactgactccctggacccaccacagagagggtggtcctcctctgtggctggctctctgagtaggtcagttctcacactggaactgctgcgagggaggaagtgcgtgtagataggaggaggccgatgactcaatcatggagtgagtgtttggagagcccggcgtcatgggatcactcatgtattgagtagagatccccagtgctgagtctcacccctcctcctccacacctgtgggatgtttcaggactcagtggcctttgaggatgtggctgtgaacttcacccaggaggagtgggctttgctgagtccttcccagaagaatctctacagagatgtgacgctggaaaccttcaggaacctggcctcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccancatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctc

SEQ ID NO: 48566 - DNA, 2028 bp, Homo sapiens
  misc_feature (1844)..(1844): n is a, c, g, or t
cctcggggagcccctggtgccccggatacggctgatttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccancatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctc

SEQ ID NO: 48567 - DNA, 425 bp, Homo sapiens
agtagagatccccagtgctgagtctcacccctcctcctccacacctgtgggatgtttcaggactcagtggcctttgaggatgtggctgtgaacttcacccaggaggagtgggctttgctgagtccttcccagaagaatctctacagagatgtgacgctggaaaccttcaggaacctggcctcggtcggtaagaaggacatttccttccttagtcaattagaagacaagtgtgttttggtcaccagtgtggttgcacagtttggaatgtggaaagagaatacgttggtgaataaatggggcatcgtgggccaggtacagtggcttacccttgtaatcctagtgctttgggaagccacggtgggaagattgcttgcgtccaggagtttgagaccagcctgggcaacatgatgagaccctgtctcttt

SEQ ID NO: 48568 - DNA, 399 bp, Homo sapiens
ggaaaggaaattaatcttttctggatacttctgtgtaccaagtactatgttcagtcctctatttactctctataattgatcttctatgaacagctatcattccattttacagatttttaaggtgtcatatactttaaataacttcttcatagctaggaggtggcgagggaaaatgcaaacaaaagtttgcctagaaccaaacccagccagcctttctactttgctgttttccatggcgtatgctcagttaatgtctgctgatcaccatctccaggacagaatctgacagctagtaataattgggaaacatatggcagacaacgtttgattatctgtgggtgttgggaatagatgctctcattagttgttagaaaaattataaaactgacattgttgagt

SEQ ID NO: 48569 - DNA, 1485 bp, Homo sapiens
  misc_feature (1443)..(1443): n is a, c, g, or t
  misc_feature (1469)..(1469): n is a, c, g, or t
aactcagtgaactggcatttttcaaatgacttatatgtgatattacaaaattatgcatggctgaaagtccattctacatgcatgataaaccagtgaatgttaatataatgccacaaaaagttcattagtatggcttgagtctatgttatagttaacctttaaaaaactaccacttgttaagttttggtgtagtatcaaagaaaaatgtccacagttatttgaaaaagccatttaagtcttccttttccaatacgtgtctgtgtgaatgcccattttcttcatacacttcagtcagaacaacatattgcaacagaatgaatgcagaagcatatgtaagaatccagcagtcttctattaagccaaacattaagagatgtataaacataaagcaaggctattcatcttactaaattttcattttttgttttggaaaatagctttttcatttatgtagataagtaattgttttcttacttttaaatgaattaatactaagtttctcagttttcatttcaaatgtggtaattatcaatgtaagtaacccttgtaaacaaacattctttggggtccttaatgatttttaagaatgtaaaggagtactgagaccaaaagtttgagtacttctgtccttaggcatccattgtattaataaattaactttttccatgcagctataatagaatgatactacttttgtcaattttggcttttgttgccattgcttttggtgttttagacatgaagtccttgcccatacatatgtaacaaaccctgcacattgtgcacatgtaccctaaaacttaaagtataataaaaaataaaaataaaaaattaaaaaaagaatgatactacttttgccccattttgcaagacttgagaaaattatcactcaaatcattttctgtgttctgtggtttggatgaggaattctggttgagcacagctggaaggaataggcaattaggggaacaatatttctttagatagagtggttatctattcctgggagacagtattggaaatgagtcctgaataaagagagggtatcagttatgggaagatttggggaaaacattcctggcagtaggactagctattgcaaaggccctgaggtaagaacaaggttggcagtgtttacagactagtggggcctgaattactggaggagagtaaacaagggaaagtaatatgacagtaaggccagagagatagccaggggccagatcatgttgggcctaattgcactgggcaggcagccatgaagaactttaagcaaaagagggacgtgatctgattagaaaaagctaactcagcatgctgtgtgaggggggagaaaggtctgttgggagccgtggcaaaagtagagatagggagacaagttagaagacattgctgcttgtgactagagtggccggccactctagtcataaaggctgctcatanatttgatcagctaagccagctttggnctgaggctaaagaggc

SEQ ID NO: 48570 - DNA, 312 bp, Homo sapiens
ctttctgctttacctgtaattttccctttccttgaataaatgtattggccagaaaaatgaagaaggttctatatcagtcagtcatagcattgatgcacgatgctactacagggtaaggagggtttgaggaggggacggtttaaggaacttaagtgaagaggggtttcttattagcatttggctgtattagctcttcgaggaggacactggtttggccagggactctggtggcagcttcttagaaatgatctccattgctaagtatgcagaaagaaaatattagaactcctatttatatttacttatggttaa

SEQ ID NO: 48571 - DNA, 433 bp, Homo sapiens
taataaccctaattccagtcaataccctgggactggtgctctcttccctctttcatatctgtatcttctttttccaataaaggggccctatttcccaacaactggaatatatttaatcatgcactaatttatataatacatataaaagacatttcagtggctcacatctgtaataccagcactttgggaggccaaggtgggcagatcacaacgtcaggagtttgagaccagcctggccaacattgtgaaaccccgtctctactaaaaatacaaaaattagccaggcatggtggcgggcacctgtaatcccacctatttgggaggctgatgcaggagaatcgcttgaacccacgaggtggaggttgcagtgagccgagatcatgccattgtactccagcctgagcgacaaaagtaagacttaatctcaaaaaac

SEQ ID NO: 48572 - DNA, 322 bp, Homo sapiens
agggccggaaagagagttagaggaggcacacttcctagcttggggcccatcccccacacattccccctgtgactgagaggctcacaaaaccaatagagcagcattattaactctgcaatatcataagagagggcttcgctctctgccttggtggagagagagaggccaggggaggggcaggctggctccaggggaaagcatgcttcattagagtcttaactcaagggaggcaactgcttgtgtaagcgcaacagatgaacgcaatgtagagaggctcccataaaaaccctggccctggtctaggagtcgtcacagcgggggg

SEQ ID NO: 48573 - DNA, 315 bp, Homo sapiens
tggtgcgactggccagatagagcagccccgtcttacctcttaatagcagaactgggacgtattcccttcatgccctgaagctaagtctagctttctctctacctacctgtcacagaataatagattctgtgcagaattcagctcctctctgttagaaaggctcttctgcgttggagatggattttttggtgtttgtgagaccaggcttttttacatctctattatgcatagtacaaaaatcacttctgctgctgctctgagccctccctaaaagacaccgaagatttgctgcctgttggcgtggctctctccagg

SEQ ID NO: 48574 - DNA, 709 bp, Homo sapiens
  misc_feature (695)..(696): n is a, c, g, or t
cggggtttggtcttgatctcctgacctcgtgatccgcctgcctcggcctcccaaagtgctgaggattacaggtgtgagccaccacacccggccctgattttttaactttatgtatgggactcaacctgtgaaattattcttgacaaggagagggtgagtcagaatcatgtgttatcagctttcatttatatgcatcctttggtacaggtgagaggtagatgatttgtttttctgacattttattatgaaaaattataagcatttagaaaattataagaattttacattgaacacccatagttttcttccattaacattttctgtgcttacagtaccacatatgtgctcattcgtttatccatcagtgcagacgtgtgtatacttcccctaaatactggtttgtttttgaaagtttgttcctggcttataccctcctgtattctcagttgacagatctttacataaagagtctgcttttttctcatttttgtgcatcttagcactttagtggtattgtaatggaatattacatctagtatgtacagtgagagaggagctcttgaatttttggtattttctgaagtttaaaaaaaaacacctgcctcggcctcccaaagtgctggaattacaggtgggagccaccacacctggcctgtatcctgattttttaactttttttttgtgacagaacgagnnactgtctccaaaa

SEQ ID NO: 48575 - DNA, 330 bp, Homo sapiens
ttggcccttgttagtatttagtataaaataattggtgtctgcctcaaaagtaaggatttaattgtaaagcaattccttctttctgaaagataactttagggaagaaaaccttatcttatgtttggggatatatagtgggacagttgcaatcattgtatatattgggtgtgttagagttgatagcctcgttaagtttctcttatgtggaaaaattatttggcattttaattcacttcattgtttttttttttctccttttctacaggggctttcattcatatattttaatttttcttgttcttcttttgactagtttattgatggccatgc

SEQ ID NO: 48576 - DNA, 1201 bp, Homo sapiens
tcagggagctggtcagacacactgtctgtggcagaggctcaagtggaactcagggctactccaccaaatggcaggtccctgggaaagaggttggggctggggcctcagggcagggggcatggaacgggtgtaagccacagggaactggagaggcaaggtgggctgtgggaggggctctcaggggaccccagatagggtgtcctcatgcctgagtaaggggcctggaccctggaccccggcccccgagcactaccaggggacagaggccctcctcaggcctccagtctgacacgggtaaccaggctcgagctgggtggcctctcatgccttcgggggcactgcctgggcacctgggtcagagctgcggccatcatttcagtcctcactgcctggcctttagtgcagggcctttgaggaatgggggccaggcttcacagtgggcacagtgctcccatctgactctgacaggcctgcacagtcggactcatgagtcccatctcccagatgaggacaccatcaggctcagagaggtgaagcaacttgcccaaggacaaaaggcacaggcctgggacccaaactttgtgcttcttgacacaccgactcccccaggctgacccccaatgcctgatcccatcaggccaggataccccctgtccagagctgagctcctgttctcgggaaggccaaatcagagccatgtggggctggagcctgcttcccgagacctgccccaagcctgccctccgggccaggtccgcagggtgggtcacatgaaacttctgacagcaggcatcagacaccagctggaggaggaatggagggccaacaccaggcaggttgcttacaaagagggcccatggggtggggcggggccaaccacagctcggcaggcgccacaggaagggccccgcctcttcctgtcagttctaccaacggcccagagcagctgcggccgcgccaaggggaagctgcaactctcaaaaacaaaaaccccaaaggaggaacttccctggcggccctggaagactctgggcccccacccccaccacggggctccctgggccgacagccaggggcaaggaggcacgcagggtcgcagcgacttggagcaagccctggggtctcgctggctgctccaccctgagtggatgggaggccaaatctctggagagtggggagcacagctgggctggctggggta

SEQ ID NO: 48577 - DNA, 347 bp, Homo sapiens
cggaaaacccatttgtctttcctaaacgaaccaatttgtccttcccatagatgtctttctcccccattcctttcccctactaagttaggtatataagccccaaattctaaccacacttttcagttactcatcacggaacactcccacatgtgcgaacattgtccgcataaataagctcttttctcttactaatgtctttttttcagtttaatttgcaggctcctattgaaataacaaaagttggtagaggaaaaagttttttctcccctacaaaggccaagaacattttggctttatatttatatttatattataatgtgaattgattataattataatgtgaattg

SEQ ID NO: 48578 - DNA, 414 bp, Homo sapiens
tgaatttgaatggaccagtccctctgaaaacacataatacataaagtaacaattatagaactgtagctttatgatgagagagaatggcttgtgcccctccctccccatgtgtgcttattattatattgttttttagttcccccacttccaaattactcttgaggtgtctgggttaaatataagactgggattgattgttggcccagttatccatttgttacaaagttttatgatagctgtatggtctgaattgaattattgctctagaaactgccagctcattaatttttctttttaaaattttttcaatgttatgatttatttacttgcaacttttttcttgctttttctttttgattttctttagtttttatttttaaaaattttatattacagacaaacagaaacttcttc

SEQ ID NO: 48579 - DNA, 843 bp, Homo sapiens
tgatttcagaggatagacctcatagggtacttagaatcctacaatagtaaaactggaggaaacaaagttttacacaggaggaaactaaggctcacggatgtcaagaaacttaatattatctacacagttaagtgacaaagtcccgattctctctagccagcactctatccaagaagaggattttactggttataaaagcatcataattttttttttcttaatagagacgggatgcagtcttaataagttgcccaggctggacttgaactcttggctcaagtgattctcctgcctcagcctccctattaagagccgcccccgattaaagtagcctgctcatacaccttacttagtatgtttttgactagcattgcttttatctgatgttatttcctgtgcctttaggatatcatctcctggtcaattaatcacaagggttttttgttgttgctgtttttaactgcaatactatacatacttacctgaaactgttcaggaatgacagttacccttaatcaaaactgggaggcaaccacttttcccaatgcacttcaggtctgtaatacagacttcacgtctacattatatggtctatagtttataggaaactctccaaggacagagacctgccaatactttgtggtaaactataactacataacgtgaatttttaaagcaatagaagaaacggccgggcgtggtggcgcgcacctgtaatcccagctactggggaggctgaggttggagaactgcttgaacctgggaggaagaggttgcagtgagccgagatggcgtcactgcgctccagcctgggtgacagagcgagactccgtctcaacacca

SEQ ID NO: 48580 - DNA, 358 bp, Homo sapiens
aatttaagtttaaaaatacattccttgttggaaaggtaattggattatagtagcccaactgtaaattagtaggcaagtgtagattgtattgttgagaagtaaaaatacttgctacaagttttatgtgggattatgatgtgatttcttttacatgcaacttttaattaatgcagtacctttgtttacttccctgtctcaatgttaaagacaaataataagttattaaagcttaaattcatatatttggttttctgtgggctttttgttttttcattatttggaatttctaagaaatcttttgatggcaaaatatgaagtgataatttttagtttttcaagttgattgaataattgacta

SEQ ID NO: 48581 - DNA, 377 bp, Homo sapiens
agataaaggaatctaatccacactaagaaccccccacccagcttcagaatgaaagcattcccagaggtgttagagccctgggttcccacccggaccagagcctgtgtggccaatctgccaggctggaactccacaagctgctcctgggagcatgctgctgcttctggatccacctgaccccgacaaccttccagccctaggtgacagagtgagaccctgtctctaaaataaataaataaatacatacatacataaaggttactgtaggtttcgaagaattacctgtatttaaatgtatagtttctgggatgtgtgtgaaagatttatttggtcattcattcatacacacatggacacaaacctagaaaagtatattc

SEQ ID NO: 48582 - DNA, 447 bp, Homo sapiens
  misc_feature (254)..(254): n is a, c, g, or t
caatatttttaattggtaaggatccccacatttagcctaagaaagtatttaataattccggggaagaaaaacatggctgaattaatggccagattctgaatgggctttgagcaacatttggaatacaagtgtgtaaggtggggttggtgagatttgcctttatttccctgaactgcctatgaattagcaaattcctaaaccagctgttttcccaattacatacaataacttgtgcctacctaagtctgtctttnctgccaagcttctacttgcaactcattttaaaacttattcctaaatacccccaaaccagtggaataatagtaggcatcaccttaaatcataatattttcacaagaacatgttcaatcttgaaataatggccaggttttagaaagtgggaggtgagaacggaggagtagtttgttttttgtcgttaaaaaaaaa

SEQ ID NO: 48583 - DNA, 458 bp, Homo sapiens
tagagcctcatttggatgtgaggctcaaggaatatgagcctcataccagttaacgtgaggctcaagggttatgagcctcataccagttaatgtggaaagatccaaggcatctcctttgagggacagaagaattatagagcttgaattatagagcttgaagcaccatgagggatatccccttgggggatatgccttggatctttccatattaactggtacctacctcattttaaccctaggtttctatggcttaagtagatggtttccagtgcgtgcattctctgggggtggattccgttaaaggagaagtggtcattttaggatgtcttagcatttgagtgagtcaagctgaagctccctcctagtgccctgttcccgcagcatagatgcatagatgcactcctttcccagcactgtccgcaggaactgggattgtcatgcttgttaatgtttgacca

SEQ ID NO: 48584 - DNA, 505 bp, Homo sapiens
gcaagtattttattctgcagttgaatctgtattatcttggtagtcctagatttcacccatttcctttttcacgttgtctttgtcttgcatctcagcctagcctcccatttggctttctcttcctgttttataaagacatgtcttctggcattgaagcgatcatacaattttctacaaatttcaaaccgtatcttaggaagcagagataatatttgattgtctactgtgtgccagaaaattcatattacatttttaaacttaataactatggtatatcatatttttctgattttacaggtaaggctcagagtcacatagtgcagttgggattttgtgtggctcttccagttagagcaaaggttcctaacattcccactgcctccacgttgctcatattctcattatattcatcattctctataatgactatacgcactggaatacatatattctctgtgatgaatgtgtgcactggaatcttctggggctagggccaatgtagttt

SEQ ID NO: 48585 - DNA, 236 bp, Homo sapiens
aaaaatacctgttggtttttaccagccataaatacactatcctttccacattcacctaagcatttagtttttacagtccattactacatttaaaccaaaacattttcctttgagtgttccacattccttggtactgtctttacttatttgcaatatgatgagggatttgggctgtatattgttcttttcttttaagccacccttgcgcacataattggcaaatagtgtcaaaaggg

SEQ ID NO: 48586 - DNA, 506 bp, Homo sapiens
tcaagttctgagccagtgtgcttgaacactgtgctatactgcctcttgaccagatgtttgagagactgtaggaacctttgaaaacaccagtactagatgatacctctatttaacctggagcccctttttctcaaatgaaacatgatacagaagctaacatgtaaaacaggttagaaggtattctaacaaagtagagacgaggtacctttagcccagctctttcctcctcatcctcccagctgcctctaaaagagctctgtggaactcaagggctcacagatcacagtttgcaaaatattcataatgtaggcttcctgtattacagattagaaaatggactcaggtgatcaagtgactctctcagagtttgttaatttcttcccctttgtgatagtgaatagagaacaatcaaaataatgaagaaagagctttgtttttcctttggttcacccagtgaactctatacctttttttatatgctgtgggaatacaagactgtaagtcat

SEQ ID NO: 48587 - DNA, 622 bp, Homo sapiens
catccaagaaggctcattcacgtggctgataattgaaactaacttctttctcactcaggtgtagtaactctattttgggggcttatttcctagcttgcttccatagatgggcctatctttcttgccagtgattggttcaggcctaagccaattagtgcatagttttcccattggtcatggtagattgagatatggtttaataaaagtgactttgaatacttcatttgatggttgcagcaaacaagcttctctgtctttactcggaggaaccttgtttgctgatcatgaacacctcaaaatcatgagggaaagccagcctaagtagggaagccaaaaaagagacaagtgtgggagctgaaggaattgtagggaaatagagctggagccctagacaaagaatgcccgaatctcccctacttccaaatacttcaggaactgagccactacatccacttaattgtttaagttagtatgggttaggttttctgataattacaggagaaagcattctaaccgatcgacgcagctaatataaatgaccaaaaaaagggtgaaataaaaggatgagattaacagttgttacttatgaaataaaagagaaatagacaaatcttcaaaaatg

SEQ ID NO: 48588 - DNA, 540 bp, Homo sapiens
ttcgttccacattgctctgcctttggagcagtctgtgatgaaggtgacctaaaaagtgagcaccattagaacttgattgctgtcccaaaccatcatatctttaaaaatcctatgatcttcttagttatgcaggtaattgaataccttgttaaataccaggaatgtaaatggccagaaacctaacagtgtaaaagagtgaaatttattagtagttcctctcataagactattttgtaaagaaataactagagatatgtttgatatttatagcacattcattgcaaccattaaaaatatcaaaattgattatgtgggaaaatgtttaatgggaattgctcagtttttttccataaaggattatagaatatgttcaatatgatcccactttttgaaaatactcaggaaaaaaggatgtatacccagctgggcacagtgactcacacctgtaatcctaacactttgggaggctcagtgggaggatcacttgaggccaggagtttgagaccagcctggtcaacatagtgggactacatctctacc

SEQ ID NO: 48589 - DNA, 139 bp, Homo sapiens
ttctgaattttttaaaaagtaaaagtaaagcaatcattaagtagttcagataaaagaaaagcatctttacctgagttacccatcaggtctactctgacccgccctagcttctcccagaacaagcttctgggtatctaaa

SEQ ID NO: 48590 - DNA, 741 bp, Homo sapiens
aagtgaaaagagacattatttgtgttctcactaaattgcatttttgcatttccatcaaggcagctagcttgacagaatttactccaggcaccgtgcagtgcacacttttatgtttggtgacacctttcaaattactaacttatgggcgaggtgcagtggctcacgcctgtaatcctcccagcactttgtgaggcagaagcaggaggattacttgagcccaggctggtctcaaactcttgggcccaagtgatcctcctgccttggcctcccaaagtgctgggatttctgagccaccacactcagcctagtttggtttttaaatccacattttgacgttttaaaaacatttaaaaaactttgtttgaattaaaaaccatatgcatttttgagtgataaagcaatcacatcatggactagggtttcttttctgctttgaaatttaatgtagtgtgtggtattcagttttgatcgttatgatttcctggaggagttcatgaaataagggggcattttgacctgtgcttgagaaaatcatgaagctttttgtgtccaaatttatataaaatatgtttgcatatgtatatattcataaaatggaatattctccacatccctatttgtgtgctttatgtgcaggagggtccaatcttttggcttccctgggctatattggaagatgaattgtcttgggccacataaaatacaccaacactaatgttagttgatgagcttaaaaaaaaa

SEQ ID NO: 48591 - DNA, 1356 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggca

SEQ ID NO: 48592 - DNA, 2076 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattgccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaa

SEQ ID NO: 48593 - DNA, 1661 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaa

SEQ ID NO: 48594 - DNA, 1151 bp, Homo sapiens
gactggactgtgtactcgccagaacacacaataggggaagaacagatctcttcaataaatggggctcaaaaaattagatatccatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaa

SEQ ID NO: 48595 - DNA, 2152 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaa

SEQ ID NO: 48596 - DNA, 2130 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatgccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaaaaaaaaa

SEQ ID NO: 48597 - DNA, 1280 bp, Homo sapiens
tgtattgaaacaatttaatgaaaatattaaatatttggtttcaaaaggcagatttatcttctcccaacattctgttatttctgatacttttgaaaaactaataaaaacaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccagtgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattgccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggca

SEQ ID NO: 48598 - DNA, 253 bp, Homo sapiens
cactaccttactttttgggaaaaccaacccagtattagttttaaactctttgagctgtgattaacattttcaaacttgaagagtttttacttttattttcttttttgagactttttttttttttacttttttgagatggaatatcactctgtcccccaggctggagtgcagtggcatgatcttggctcactgcaacctctgcccccccgccccccgtccctccgcccagttcaagtgattttcctgcctcagc

SEQ ID NO: 48599 - DNA, 378 bp, Homo sapiens
acctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggcgtcctcgtcctcatccgcgtcatcatcctcggggtcctcaaccacctcaccctcgtcctcggcctccgacaaggaggaggaacaggagagcaccgaggaggaagaggaggcggaggaggaggaggaggaggaagtccccaggagccagctctcctcctcctcaacc

SEQ ID NO: 48600 - DNA, 351 bp, Homo sapiens
cccagcccagctctgactccctcccttcctgcagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggcgtcctcgtcctcatccgcgtcatcatcctcggggtcctcaaccacctcaccctcgtcctcggcctccgacaaggaggaggaacaggagagcaccgaggaggaagaggaggcggaggaggaggaggaggaggaagtccccaggagccagctctcctcctcctcaacc

SEQ ID NO: 48601 - DNA, 608 bp, Homo sapiens
tctcacccctccttggtccccagaacccatcatgcagcccacagaagcagagcccatggagccagaccccactctgtccctgtcaggaggctctgccatcgggctccttgcggctgggatcctgggagccggggcactgattgcaggcatgtgtttcatcatcatccagagcctaaggactgacaggcagagaataggaatatgcagctgaaatgtgggcaactctcctgtcagctgaagagatgggtgctttgtacctctctatccacgtggaaaaaaaaacccatcccatagcttccaagtctacaacatctctgttcaagggaacaacccaacgtaaccagactccctttgccctgtttctgaaacacctgaagaaaacatctgatgggttgactcggtgccatccttggtcccatcgccgtgacacgttgtgcaagcaaagcatcagaggctcatccctgtctgtgggagctcagtgctcagaaaacaggggggaggttttaccttggaaattggccagaccccaaaatatgtcttttacacatgctgctttttttttctctttttcaaaaagaaccaaaaaataaattaaaacaccaccactt

SEQ ID NO: 48602 - DNA, 904 bp, Homo sapiens
tccatctcacagatgaggaaattgcagaactgagaggttccctaactgtctaagggtcaggccacttaccactgctggcaagtggtagaggcaggatttgcgatgtggttccagagcctactccttaactaccatgcaattccgcttgttcatctttgggtggttacccaccgggccttaaggtagtcttttcattttttcttgaatggagacagtctgtcagagttcgcaggaagtgtggtgtgctggtgacagttcacattccaagttaagcccccttaccacgagcttcattccgttggtggtttacgtgtggggggtgctggtgacagtgttggtcaatactagaggggcatggctaggcagcagctgcccagtcatttaaaactgaacaataaatagaacggggttgttaggggcggaacgaaggggcctagtgggaagtggtttctcagagggagatagttcagtcgcactagaagaatattttcttcagttaacctatgtgtaattttcaggcttatgagaagaaaggccctgttctcatcaccctcccttttgattcttctttggtctttttccatcatccatctgcctgccctgagatgctcatctgaggcctgattccatcaggtggtctgaagaaggtttctatgaagtctttatgagctggacttcagttttgttttgtttgtttgtttgtctgagacagaagtaagactccatctcaaaaaaaaaaaaaattgagtgcctactgtgtgcacatgtaccctgtgtgaccatgggccaggcacagtggttcatgcctgtaatcccagcactttgagaggctgaagcaggtggattgctcgagcccaggagttcgagaccagcctgggcaacatagtgagactccgtctctcca

SEQ ID NO: 48603 - DNA, 775 bp, Homo sapiens
tccatctcacagatgaggaaattgcagaactgagaggttccctaactgtctaagggtcaggccacttaccactgctggcaagtggtagaggcaggatttgcgatgtggttccagagcctactccttaactaccatgcaattccgcttgttcatctttgggtggttacccaccgggccttaaggtagtcttttcattttttcttgaatggagacagtctgtcagagttcgcaggaagtgtggtgtgctggtgacagttcacattccaagttaagcccccttaccacgagcttcattccgttggtggtttacgtgtggggggtgctggtgacagtgttggtcaatactagaggggcatggctaggcagcagctgcccagtcatttaaaactgaacaataaatagaacggggttgttaggggcggaacgaaggggcctagtgggaagtggtttctcagagggagatagttcagtcgcactagaagaatattttcttcagttaacctatgtgtaattttcaggcttatgagaagaaaggccctgttctcatcaccctcccttttgattcttctttggtctttttccatcatccatctgcctgccctgagatgctcatctgaggcctgattccatcaggtggtctgaagaaggtttctatgaagtctttatgagctggacttcagttttgttttgtttgtttgtttgtctgagacagagctttgctctgttgcccaggctggagtgcagtggcacgatcttggctcactgcaacttccgt

SEQ ID NO: 48604 - DNA, 304 bp, Homo sapiens
caagagtttgtgtctggtgagaggtggactgcagcacgtgggagagagaacagtgcgaaactgggagatggctagaaagggcgtcaaagtcctcagcagaatttctgtagaaatgactactacagctgacatttattgagcacatgagtatttcattctcataacagctctatgaggtagggatgactgtcatccttattctgcagtgaggtaacagccttggaaaggttaaaaaaaacttgactaaagtgaacaactaggtagtggtggaactggcattctaaggcggtctcactccagtccc

SEQ ID NO: 48605 - DNA, 355 bp, Homo sapiens
agaactggattatgagaaaaatggaaaagagaattccatatggagggaatagcattagcaaaataagaatgctcaagatttgtatggaaaataagtggttcattttgttgacgatacgatatatgaaaggaattagcagagcgtaagtttggagaggaatgttggagctactgatagaaggatttgaatgcaggaataaggaattcaagccttactctgtttgaaagccccagtgataaaggacattatcaggactatctttatgagtttgacaatgttacgtggaaagacagactgaaataaatacgactggttctcgaataatgtttcattcgatgttgtttcattataatgt

SEQ ID NO: 48606 - DNA, 179 bp, Homo sapiens
gagaacccaatcatattttaacatgtacactaacaaatattttaagataaatgtggcttcttcaggttttataactcattactctttcttatgagcacaaaatttctgatgatagaagcgttgaaatttgctagttaaaggtagttcagtctctttcaaattaaaagtttcacttgctt

SEQ ID NO: 48607 - DNA, 366 bp, Homo sapiens
ctcactgaaagatgaatacactgaggtttataatattgtgaaacttacccaagctcatgtgattacagaatagagccggccggaagcggtggctcatgcctgcaatcccagcactttgggaggctgagacgggcagatcacgaggtcaggagattgagaccatcatggctaacacggtgaaaccccgtctctactaaaaatacaaaaaaaaaattagccggtcatggtggcaggcgcctgtagtcccagctactcgggaggctgaggcaggagaatggcgtgaacccgggaggcggagcttgcagtgagccgagattgtgccactgcactccagcctgggcgacggagcgagactccacctcaaac

SEQ ID NO: 48608 - DNA, 345 bp, Homo sapiens
ccccagcattggggattacatttcaacatgagatttggatggggacacagatccaaaccatatcatcactgaattgaaactactcttgataaggtcaccaatgatcttcatattgctaaatctcaagttaatttctcaatagtcatcatttctcttgacttagcaacatttgatttagttgatcattccttcttatacatacttttttttcacatgacttctgggatgttatactttaaaaaaatcttctgcactcactttcttgatgatcgtgactgtaaataccaagtatgtgcttacaactcctaaatttatgtacctgtttaagaaactattcctgaattg

SEQ ID NO: 48609 - DNA, 241 bp, Homo sapiens
ggatccggttgcagtgagccgagattgcaccatcgcactccagtcttaacaacaagagtgaaactccatctcaaaaaaaaaaattaaaatataaaatgtagagaaaaaaaacccttcatgggtagaagaagactttcctaagtgtaaagtacagaagtggcacactgaaatccagctctgaactccataaacattttaagcttctccagcaaaacacttcccagagcatttaaaccactga

SEQ ID NO: 48610 - DNA, 371 bp, Homo sapiens
  misc_feature (368)..(368): n is a, c, g, or t
  misc_feature (370)..(370): n is a, c, g, or t
attctaagaccaaggtcagtacgggagtggatctggggtcatcactgccctagagccccggcaccagtaggcagttctctggggcccccacatggaaacctcagcagccctgagctatattcctggcctggcgtctctggaccacactgcaggcacgatgtggggttggattctttcttcacgacaccaattggccagtctcttgtatcacccctgctggccaaataatcatcttggaccccgaccattatggacctatattgagttccctccttgctgaatttggactactagagtactcttgtctgaagcacattttattttattttattttattttattttaagacagagcgagactgcatctcnant

SEQ ID NO: 48611 - DNA, 651 bp, Homo sapiens
gagaggaacaaagtaatctgtaatgaattgtgatcaattagttgtaagcactactgcactcagaccagcctgatgtggctctcttttcagttaaaactacttacctggaaagagtgagaaggcaaacagtgccctgggaggtgtcagaagctctaagtagcattagggagaatgttctaggatgccggatatggcagctacggctaactgataagaagacaatttccttctctctcctgaaagccgcctcctcttccttcttctcgaagaccctctatgcaatccctttagcctcccacttcctccccatggcctgggtgccctgggttgatctctggtgatggccattcacccggctgggcccaggcttcctgagggtctcccattgacacagtgaatttgccatgtgacttgcacagggaaatttggacagaatttcccaaagaaaggactggagcagtttacactcagattaaaaacacagaacacaatcctttaatccggtaacaatcacttgatttatttatttttttcttgatgtacatttttatttttatttattttatttattattattattattattaatttttttgagattgcgccattgcactccagcctaggcaacaagagcaaaactccgtctcaatt

SEQ ID NO: 48612 - DNA, 703 bp, Homo sapiens
ctctctatgttgcccaggctgatctgtgccttttttaacactaaagtattttatgttgtttaccatcaggaaaagaagatacaaaaaatgggccacacattgtcttttggatttccatgctcgtaggcctgctggagtgaccctggggggttgtgccccttagttgagaagtgggactgggtggaaggagcacagaccctggattccaagctgggtttgaattctagtattgccaccacttactagccatatgactaggaggaatttaattgacctctctgaactttggggcctttgtctgtaaagtggagtgattatccccactttgaagggccattttgaggatcagcgatacatttaaagcagcaagtacagtatgggatagagcaaacgtgaaaaaaatgtggttattgctgtgataaggcactgtgtttagaagacaccatgaacactttgtgtcccgagaaactagaagtcagtattggacataccatctttagaaaatcctaaagaaaagctgttaactgtttagtaatgtgtattgagtacctactatgtgtcaagctgttctaggcactagatatatagacgtaacaccaggaacctgcctacatggaacttgcactttaatggggatggaggatgggtaaatgttaaattaaccaaatgcacacaaatatatgattatgaattgtgtcaaatg

SEQ ID NO: 48613 - DNA, 181 bp, Homo sapiens
tagactaaaaaaggcaggcaatagcaagcagtggcaaggatgtgaaggaatggaaaccccgtatactcctcatgggaatgtaaacaggtacagctactttggcaaaaaataattagtaagtccttaaaatgttaaacttattgtttccatatgacctagcaattccattcctaggtatata

SEQ ID NO: 48614 - DNA, 505 bp, Homo sapiens
aggcatagcagaatcagtcattggatcaggctagggtcaaatactaggaaatcaccacatttgtcagagaagaatcgtgataaacaaaaaaggccagaataggtcaagaagggacaacagcaagagccagccagaccagcagtgttgatgaggaaccaaaaggttagagcattactagcacatcttgagacatagtttagaaagagcagacctgtgaaatggaactaactgcacagctcagagtcagcatggagacaggtaaaggaaggaaaatctggttcaagtaaatagatgcggacaagaaactcaagactatagccaggcaagtccctactatcacctcctctgtttctctttctaactctgaatctctggcataacttaaagaggaaagcttccagaaatcctttgctctaatgtggagaaagttccaggaatctctgatttcctgttttcttacatcctttgtactttaagcttcaagtattaaagtataaggactctt

SEQ ID NO: 48615 - DNA, 265 bp, Homo sapiens
ccgatttcttctttttaataagaggggagaaaagagtttttgtctttaataattggtagtgaaaacctctgaccttttctttactgggcccagtggaaaatttattagaattgtttgtagagcagcctgccctttaatatgctactttacttagtttatttactccactaaaatacacctgacttctcaactggaacattctccagcattacttgttggtctgaggaatagtagtgtaaaaagtagatgaggggttagttgtggt

SEQ ID NO: 48616 - DNA, 333 bp, Homo sapiens
ggaactttaatttataaaataaatacaagcaaactgttctgaccaaaatgggggtgggggtaagaactccttcgtaggattccaaggaatccctgagcttggcacagcacagcctgaaaagtattatctacagatagtatttggattaaaaaaaagcatctggcacatacagctttctgggacttttaagtacttctaggttaaaaataaagagatcacaaaaattaacagctctgatcaaaactgcgttattactcaaagtgagaaagaactggggtaacatacataaaaatacactggcttaccaaataaaattgtatttaaacattttaa

SEQ ID NO: 48617 - DNA, 193 bp, Homo sapiens
agggaaactttaacagaaggtttctttgcatactatgcatgttcttccaggcagggaagattaatgcaatacgtcaggaagtctaagctcaacttttcagaaaaggactttttttttttttttttttgagacggagccagcttcatttcgccactgcactccagcctgggcaacagagtgacgactctgtctc

SEQ ID NO: 48618 - DNA, 790 bp, Homo sapiens
ccaaacactgtggtccacagagcagcaggaaactcaacatagtttcagcatgtcctaagaatgtcacatggattactgacacaaccactgattttgtctcttctaaggtcagatctaaacattaaggcaagagttggaaaggaaagaggctgaccatccaggatcctaagcagaaacccacagagaagcctgttggggagttagaacagagagagtaactcgccaagggctttctcttgcccaaggagtgactcacccttcaggacaagccaagggacctccctgtccatcattaactgccatctatgagacagaaacatatccaacctttaaggcccttctgaacatatacagaattttgtcttcagctgattttctcgaattcttagttggtttcaacaattagttaatttcctatttgagggaataaaattaataatttacagaaagatattctcattgttttccaggatcatatttatgtctttaaaatttagtaacagaaatattagatttttatatacagagagagagacagggtcaccctctgtcacccaggctggagtacagcggtacagtcgtagctcactgtaccctcaaactcctgggctatcctaccacctcagcctcccacgatgttgggattataggcttgagcccctgcaccgggacagattattttttttaagcctagaggaatccaataagtttgagttttggttaaggatgcctttgcactcagggagctgaaggtagattgttgtccagttctgatctattttccttaaaa

SEQ ID NO: 48619 - DNA, 345 bp, Homo sapiens
gcagttttgatttccaggaagcctttagcaatttatattgttagtacagtaagagagtaaacaacacactaaaataccaagagaaactactttccaaaacatgttttagtcgtttaactttatgaatatggctagcaagggggcttcctgggggacagtgctggggaaagagcaggccctaggaatgggctttgaaagaagacttttgccaccgtcaggtcacatttgcaagaggccatcgtcgtggtctgccagggaacccttagcagaaaggctgctttgcccaggatctggcttgccgccccagaccagccctaccgctgtctggcattgaatgtccctggt

SEQ ID NO: 48620 - DNA, 161 bp, Homo sapiens
actctctctaacatatctactttcattcgatccaggtccccaccactctcccaacctttgtgaggctgtcattggaatcttgcgctgggaacaattacagccgaagcatgacttcctggcattacctaatctttctaattagcctcctaaaggcagacaag

SEQ ID NO: 48621 - DNA, 1874 bp, Homo sapiens
agaaagagtctccaaaggctagcaaaatgcccatcctttaaacagaataattagcaaagagaaattggagcagagcttcgtttagaaaacagttggtttttggtatgaatttgtcacttttctaatgtgaaaaatataagatgccaacgccaaaactgaaagtcaggactcaagatacttgtatccatttagaaattactatagccctgttattcagtacttctgccaatatcaacttctaatgcaagggaacttggaacaatggagaaaacagtggaaaagttggaattggataacctggatcagagtccttgccctgttcctacagctctttagccttaaggatgtgtcctaaccttttccagtcccagttgacttgtccatctaatggggatgaaaagagaatatatctcaagacatttttgtagatcaaattggcaaatccatgttatgtgtttagcatagtgcctgtcatctagcatacagaataatatatagtaataatataattatagtgatataattattatattagtgattataattattataactaataatatagcacagtaataatatatgaatataatatataatattgctaatattgtaatttttggtgaaatttattatagtaccacccaaagttagggactgtcatgaggaataaatgatgtgtgcatatacttttgtgtaaatacctatcacagtgattggaacatagcagggctaaatgaatagttgttgaataagctaatgtattggggaagctacaaagggtagattgttatacaaatgcttgtacttcttatttttaacaaaaatagattgagcaatcagaatctctctatgagcaaacaaaggaggtcaaaagatgctcaaaaatgtccctattgatcaagtatgttattagaatatttagcaatcaatagggcatggatgctgcccgactggaataaatgctggcagtagctcctgatgagggtcctaagggccccaactctgccatgcattatccctttagttagaaattgtggaaaggtcttggaggggtcctaagagtgtaccagagaagaggaagtggtagtatggggtgaaggtgtttgcataggatagcagccatgttccaacaagtacaaagcaatttcactatcttaatatctggtttagctgtgctggtgcttctgatctaaagtagctctgccccacaaacaaaatcctacataactagagttgaaaagagagacaatatatcctgtatatactatgttcctcaattcacttcccatcctaaacacagggacaaggatttgtttgcttgaaagtaatgatctgtcaacaaactgggtcaaagaaaagaccctggcagcttagcctgaggagaagggtgctagtatcacatcacgcatctataaaatgtgggccgcttttggaaatacgtgggtgagttgccaattgcatcagcctagctgttgcagttcttgataattattagtcatctttgttccagcaaaatcctcatcattctcaatagattagaggctaaatttcaaatccactttagtaaaaatctttacaattggactgttagaaaccttgcattatttgaacaaaagtgacgtatttgaagatcagtgggaaagttggaaaataaaccaattcctgctcactaattatttttttaaatgccatgaatggaggcttggtttcactgaatatgcctttaaagatttttaaatgttttatatccagtcaagttgagatttttaagaacatttttaatatgtaataaaattttataatgacttttttcaaaaaagttaacaaactgcaagcacttgttaataaatgtcttaatttaaaaaacgaacata

SEQ ID NO: 48622 - DNA, 1089 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48623 - DNA, 1173 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaaaaaaaaatctcgagggggtggcctgggaccccaattttgccctataggtgagtcgttttacaaatacacttggcctgcgtttta

SEQ ID NO: 48624 - DNA, 335 bp, Homo sapiens
cgactactactactaaattccggccgcgtcgacaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48625 - DNA, 1085 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcaggttggtgtcactgtaggtgttgactggggatttctagtgtgggggggtttaaggcagagacttgtgggagtgccggtcaggtccgtccctccaccctccacctccaggtctacgggaactgatgacccttgggaaagggactaggggtcctaggagaagaacagggagacctgtggtagtttaaaaataatcatcctctgctatctaagactgctttccggacccccaccctcctcccgaaccccgcctcagtcttaaagatagtttggaaataatctgctttctcactctttgtctgatgggaaaaacgaactgacttgcatgcactgtggagagggggtgaactaggggaaacaaaaggtgggaaactttccatatccgaaaccctaaaggaggaaagctacgtgtgtcagtctctggcgctggtcggcccaccaagcgctcgccccacccccaccgtcccctcccgtttccagttttatctgcagggctgttgtttccagcaagacccaaagctagaaaaggaggaggaagaaactgacccgatcagtgccaggtaggtgagaggaatattataaagtctcctggggtggagacaaaggttgtaagcgccaccgttcctgccggctcccttccaccccacccctttcccctcttcttttctctcccccttctcctttcccctcttcctctgcctgccagccacctttctcttttctggcctggtccctgtgttaggccctatgggggaaaaaggtctggggagggctggacggcggaaaggagggccttggaaaaggttagagggaaggacaagagagaagtgaggaggtggaaagtggaggtaaaaggagtggggatagtgaagctctgattgctgactgggcttcttaggtggaagatattttataacagctctgaat

SEQ ID NO: 48626 - DNA, 340 bp, Homo sapiens
attcctggtcgcaggaggaaacttaaaatttccactaataaaggatctatgttgttacattgctgtgtctcctacagtccctagaactgtgacttgcctttaataaatggctattggtagtaagattaatcatcctaaacttgggaatccaccactgaagcataaatgtgcttgaagaagactttgcctggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48627 - DNA, 1648 bp, Homo sapiens
  misc_feature (1094)..(1094): n is a, c, g, or t
  misc_feature (1175)..(1175): n is a, c, g, or t
  misc_feature (1187)..(1187): n is a, c, g, or t
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaaaaaanaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaanaaaaaaaaagaaagaaacagaagaaacaaaagaggaagagagaaggcagacacaaaccataaaagagggggaaggcgcagagcacaacgtcaccatcacgcgcgcagagggggagtaaaacagcgaccgaccgcaacttggtggagagacaacacccggaggaaacgaaagctaaatcaatagagaagacaggaggagcatcaagcagaagacaaagccatgcgacaggggagacagaaaaacaccgccaccgatgcgtgatcatgaagagagaaacagaacacacacaaaaacgacgggaggagagagggacagaatgaacaaccgaccagacaagaagaaaacaccaggagcgagaaaacataaacaaaatatccatcataggcagtgaacaacagtcctaatcggaggaaaacgagcagcgcaacacgaaaaaaaaacaaagccggcggagagaggat

SEQ ID NO: 48628 - DNA, 1530 bp, Homo sapiens
  misc_feature (1106)..(1106): n is a, c, g, or t
  misc_feature (1118)..(1118): n is a, c, g, or t
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaaaaaaaaaaaaaaaaaanaaaaaaaaaaanaaaaaaacaacacctgtgtgtgcgcgcgcgcgccccgcgcgcccccccggaaaaccccttcttcacaacacccctcgtgtgggggggcgcgcgcgggcgccccccatggtgagtagcagcgagacaaacgtgtgcgccacaacagggtgtgttcccaagagagaaagcctcggggcgaaaaagaaaaaccaggcgggggggagttctcccacaccgacaataaaagaacacagcgcccgcgggggggacacagcgagagagggtgtttttgagaaaacaaaattccccgaaaagagagagggagtacaccgaggagaggggaaacacaacgggggggggcatcttaacaccaagagagggagagagccacacaaggaggagagcccgacgaaatatcaaaaaaaaagccccg

SEQ ID NO: 48629 - DNA, 1566 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcaggttggtgtcactgtaggtgttgactggggatttctagtgtgggggggtttaaggcagagacttgtgggagtgccggtcaggtccgtccctccaccctccacctccaggtctacgggaactgatgacccttgggaaagggactaggggtcctaggagaagaacagggagacctgtggtagtttaaaaataatcatcctctgctatctaagactgctttccggacccccaccctcctcccgaaccccgcctcagtcttaaagatagtttggaaataatctgctttctcactctttgtctgatgggaaaaacgaactgacttgcatgcactgtggagagggggtgaactaggggaaacaaaaggtgggaaactttccatatccgaaaccctaaaggaggaaagctacgtgtgtcagtctctggcgctggtcggcccaccaagcgctcgccccacccccaccgtcccctcccgtttccagttttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48630 - DNA, 964 bp, Homo sapiens
tttttttttataaaacttttattattctagcaaataataatgtgtgttaattttaggaatatagaaaatacaaacaagcaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48631 - DNA, 950 bp, Homo sapiens
tgagtcgaggtggaccctttgtaagcgcagtcgccccacaggcgcgattccccccgcatcgcctcccgtggaagcccaggcccgcttcgcagctttctccctttgtctcataaccatgtccaccaacgagaatgctaatacaccagctgcccgtcttcacagattcaagaacaagggacaagacagtacagaaatgaggcgtcgagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48632 - DNA, 843 bp, Homo sapiens
ccctctatccttaatcttcatcttactggttgtctgaccctgcacagtgggaactactgccttggagcagaaatctatagatgatttgagggaaccgagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48633 - DNA, 897 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagcagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48634 - DNA, 1035 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagctatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48635 - DNA, 1010 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48636 - DNA, 1104 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacctttaaaaatggccgcataataatgtgtgttaattttagagaataagaaaaaaaa

SEQ ID NO: 48637 - DNA, 1001 bp, Homo sapiens
  misc_feature (34)..(34): n is a, c, g, or t
tctagaggatcccggtgttccctttgtctcatcnatttcatccacttctctaaacatatcttcattgcttaaattttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48638 - DNA, 892 bp, Homo sapiens
ctatggatccccgggctgcaggattcgattagtgattgtgccaaaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaa

SEQ ID NO: 48639 - DNA, 373 bp, Homo sapiens
ccataatataccttttgctatcggctagtctaacttcctgactccccttttggtgctgtctgtgatcacctcccaaataaacaacttgtgcatgcattcttgtctcatggttggcttctggtggaagctaatgtaatacacagtccctgtgctctcatagcaggctacttagactttccccttcctaacttcatttagcgtgggcaatactcgtttgagaaaagtcgttgagatcagaaacagcatctttctcagcatgttcctttcaatacctagcacaatctcttactcgaagtaggcgttcaacaactaaaggttaagtgtaagtgcttcaatgaagaggaaaatctgcattatggcacttaaaataaaa

SEQ ID NO: 48640 - DNA, 417 bp, Homo sapiens
aaaattaatattattgctagaatttctgcaacaaaatgactccacaatattttttaaattaaaggtttgacttagaattcttatgtaaatatatattcaactgatattggtagttataaaatagtgttctgaatcaactattttctgaatagttttctgaatcaaattcagcttcagagttttctcttttagtcaaaactttgccaaattaagctggtaaccgatgcagagcccagctttctgaaatatggatttagacgtgcctgtttgtttttccctttttaatatcaattatctaattcataggtccaatacctgtgcaccaattcacatatatatgttacctcctaatctctggaagcacagtggatgggtccctaatatcttgtcagagagttaatattttggccaaaaaaa

SEQ ID NO: 48641 - DNA, 484 bp, Homo sapiens
ggacctgaatatgtgttttcgagttggggatcaccattcaacccactaggcctccgggcatacatgataggggatgtagctcctgtaatctgtataaacctaggtctaaatgtattcctttgagcccatcttgagaggccttttttttccctcttcagagttgcttaacttttccttgttaagaaaacttctcaagttaccaacagcaagaaagattttcatcatttctagaaaaccccagaactgaagggaggccaagatgttagaaggaagcaacaccattcctcatcctaaaagccctgattttcttctgcctgcctggacattctccaccaagcccaaatgtcactctttgaggcttcctgaaaccatcctctcacacacccctactcacaacatcatcagaaacacagtcagctttctgctgactttcactaatcaggtgtgtgacttcagtctgctcttcaagtttctaggcttgttt

SEQ ID NO: 48642 - DNA, 3987 bp, Homo sapiens
agggcgggctgggcgtattccacgagcgcctcggcggttggcgaagcggacggggtgcagcctccccggtgcgaggaacggtctccgctgacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaa

SEQ ID NO: 48643 - DNA, 4078 bp, Homo sapiens
tctggccgagcttagttagtcgggaccgacagcctgacgtagtagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgatttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatc

SEQ ID NO: 48644 - DNA, 2401 bp, Homo sapiens
gtacccactagtcacgttggctactagtccacggttggctactagtccacggttggctacttctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgatttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatc

SEQ ID NO: 48645 - DNA, 522 bp, Homo sapiens
gatgaccccaatgaggactggtgtgcagtttgtcaaaacggaggggaactcctctgctgtgaaaagtgccccaaagtattccatctttcttgtcatgtgcccacattgacaaattttccaaggtaagatagtacttcccttcccacattcttttactgtaaacttttgaagattattttaacagaaagcctttgaaaaaacttaaatgaaattccacttggcacaagtgtatactccaaaatcccaatgaatagtctaggttttcccatacccttccgcttattctttgtgcttctttcaaaaaactaatcattcagcctgagcaacacagggagaccctgtctgtctgtacaaaataaaaaattagccgggtatggtagtgcatgcctgtagtcccagctactcaggaggctgaggtgggaggattggttgagcctgagaggtcaaggctgcagtaagctgtgcttgcaccactgcaccccagactgggcaacagagcaagaccctctccctagtcattac

SEQ ID NO: 48646 - DNA, 5470 bp, Homo sapiens
agggcgggctgggcgtattccacgagcgcctcggcggttggcgaagcggacggggtgcagcctccccggtgcgaggaacggtctccgctgacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgatttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatc

SEQ ID NO: 48647 - DNA, 4977 bp, Homo sapiens
gcccaggctggtctcaaactcctggcctcaagcaatcctcctgcttcagcctcccaaaatgttgggattacagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacaggtaatggctcagaggcaacaggtgcaacggaggccagcacctgtgggtttaccaaaccctagaatgcaggggcccatccagcaaccttccatctctcatcagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgatttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatc

SEQ ID NO: 48648 - DNA, 3404 bp, Homo sapiens
cgcttccgcccggagagagctggccgggttgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatcttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtcttttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttg

SEQ ID NO: 48649 - DNA, 3588 bp, Homo sapiens
cgcttccgcccggagagagctggccgggttgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatcttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtcttttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttgaaaagaatcaacttagtaaattatgtcttgcacattccaaataggaaggtatttactttatcaagatgtgtttcatttgtgttctgagtaccagtgaggggataccgtggtacagtgttttgaattgtgtactaatatcattaaagcatgggattttagtggctttttaaaaaatgtgacttaa

SEQ ID NO: 48650 - DNA, 3182 bp, Homo sapiens
cgcttccgcccggagagagctggccgggttgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatcttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtcttttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttg

SEQ ID NO: 48651 - DNA, 3350 bp, Homo sapiens
cgcttccgcccggagagagctggccgggttgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatcttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtcttttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttg

SEQ ID NO: 48652 - DNA, 1405 bp, Homo sapiens
cccgcggcatatcgtcgaacccaacgccgatccaggcctcaagactcgctggcgcgacacagcaagctcgccagcctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtcttttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttg

SEQ ID NO: 48653 - DNA, 2556 bp, Homo sapiens
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctcta

SEQ ID NO: 48654 - DNA, 785 bp, Homo sapiens
ttagtgaattgagtgacttcatagaacataactactgcgaatcacaagaatagactgacctgattttatgcctcattggcaaatggcagctgccttggtgcaagtgtcgggatgggtgccaacagcaaggtgcttttctagagctgcttatttctaagcaatgcactcttccagtttttctccttttttacttttttgattgtctttctggttttagacaaattttaaaatctgcttgttcccaggggggccccacctcatccaatgttttgtttccagcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagtaagtacatgacatctgttttcactaataggtaatatgagaagaatatcctttgtggaggctactgtttgtatattgcacacttaagcataatttaaagtcagagatccgattttaatgattcagagtgtagattaatacagacctttttgtaagcaatttagcaacacataaaacttttctaacccttggccaaagaaaacccaaagcctaagaatgtgccttgaggaatcattccaaaaaagaggatcagtgaggtttgcataagaatttcgatttccattttcttaccagaattttccaaacacatttcaactggttgagtacatta

SEQ ID NO: 48655 - DNA, 2535 bp, Homo sapiens
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctcta

SEQ ID NO: 48656 - DNA, 2296 bp, Homo sapiens
actcgacatcgcctgactccacatcggcagtggggataaaaaaagcaaaatggtccatgactcttaggagctcataagctaacaaatgttgcttcctttgcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctcta

SEQ ID NO: 48657 - DNA, 3024 bp, Homo sapiens
  misc_feature (2762)..(2762): n is a, c, g, or t
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgaaaaaaaaaaaaaaaaaaaaaaaaaaaaaattttgggggcggccactgcagcctcggaaagaagttctaagaaacacctgccggcggggcggcgcggggggccccatgttggtgttagacgtgaacaggggcaaagacgcgttgccgaggagaaaactcggtggcccaacgacaaggcggctggcgggctcctccaccccatataaaaaaccgcgcggggcggaacacccgcagccgtcggtgaaccacaaccncaagagagggaggttcgcgaggggaacacacgcgggggtccacaccaccgggagggccccaaggcggagacgggaaaataaaaataacccgcgggcggggggaaatcaacaccggcagcagagccccacaaagacgacgacccgacgagacgagcgcagccacgcacgacggcagcaacaacacctaacaacgaaggcacggccaacgacacgcacacgcaccaacccagcacatagcaccacacccaccaccaacaccaga

SEQ ID NO: 48658 - DNA, 1827 bp, Homo sapiens
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaagtaagccacacttctccacctcgtctcagcttagggactggttagatcgtccaggtgacaacacatgcttctgaacctacacatctgccttgctttctgaaaacaattttctaatgtttttgaaaaagtaatgtatgcatgtattgtatccatcagaatcctagaaggacacagagaatgctcttaaactggggagtttctggagagtttaataaagatgtgggctgggcgcggtggctcacacctataatcccagcactttgggaggccgaggcgggcagatcacttgagctcaggagtttgagaacagcctgactaac

SEQ ID NO: 48659 - DNA, 686 bp, Homo sapiens
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaaattgtgctttttgagtcttcataaatcttccactctgcagacaaagaagaatgcacctggtgtaattttcagcttaactgtaacctttcacttcccaggtttaaagcagttactctggccttaagcctccaaagat

SEQ ID NO: 48660 - DNA, 3071 bp, Homo sapiens
  misc_feature (2809)..(2809): n is a, c, g, or t
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctctaaaaaaaaaaaaaaaaaaaaaaaaaaaaaattttgggggcggccactgcagcctcggaaagaagttctaagaaacacctgccggcggggcggcgcggggggccccatgttggtgttagacgtgaacaggggcaaagacgcgttgccgaggagaaaactcggtggcccaacgacaaggcggctggcgggctcctccaccccatataaaaaaccgcgcggggcggaacacccgcagccgtcggtgaaccacaaccncaagagagggaggttcgcgaggggaacacacgcgggggtccacaccaccgggagggccccaaggcggagacgggaaaataaaaataacccgcgggcggggggaaatcaacaccggcagcagagccccacaaagacgacgacccgacgagacgagcgcagccacgcacgacggcagcaacaacacctaacaacgaaggcacggccaacgacacgcacacgcaccaacccagcacatagcaccacacccaccaccaacaccaga

SEQ ID NO: 48661 - DNA, 1979 bp, Homo sapiens
tccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatggaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgagaatgtgaggagtaaacccattgagaactgggatcagattatcggggcggtctaatatactcgtactgt

SEQ ID NO: 48662 - DNA, 599 bp, Homo sapiens
acgtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggtgaggggcgggaggcagcgacaccgccctcgcctcccctggtccggcctggtttaatccgttccctgaccgcctgagttcgcggtttatgaggtccttggggcttccaaggaggcgagcctcagggcccttttacctgcacccctgtgcaggaggcagcgatgaaggggggggccctgggcgtacagcctggagccggagtggcaccgcgactgttttgtgagagcagagtaagccactgtgatagcccggcagctgatgagctggtttacgtcaggtgtttcctccgctgcctgccgaggcaccggacgggtgagcggtccaagaatgtggatggtccagtgtccattcattacagggatcatacgtgtaccttagaagctctcttgaaacacctgcaccttgcaacctgctgctca

SEQ ID NO: 48663 - DNA, 794 bp, Homo sapiens
gagaaaactataatttattatcacaataacatttctaaatcaagtcagtttcaaagagaagttgatttactctgatttaggcagcatttcctctaaatgtggaaaaggtttttaagttactttacctggaaagacatttttatcagatggcaacgattttactcacactttctatagtttcctatatccaagttgtgattcttcttaaacaatctagaagatatgcagtactaatgctttaggatatcatctccatttttattgatataagtacaacttcagaataatttattttaggcctttctaagatgactttagctatagagtttggggacaggatgaattagataccttagatatgtctgatcctaaaaatgtaggttctgaaatatattgcactagttttcaaacaattaaaataattaagtacaccgtcttagatagataaatatattttccaactcatggcaaacgaattgctctgtataaagaaaatgtaactaaatattagcagctacttgataatgcatttacttatagtcctgcagaaaagaagatgctggctggctggctgacaatattaacttggaacaccctggtgtatccagatcctcctgggagtgtctctaggggcaggttgcagagcttcaaccttctccctggcccgtgcaacagaagcagatttaaggatggccccagactgagagagatggagacagagatagagataaagggcaagagccagagtgggagacagtgtgtgagaacatccttagaagaccaaattagcatta

SEQ ID NO: 48664 - DNA, 2605 bp, Homo sapiens
agcgattctcctgcctcagccttccgagtagctgggattacaggcatgcaccaacacgctcagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48665 - DNA, 364 bp, Homo sapiens
ttactaagagctaatagaaaggctaggaccaaacctataatagtttatgctgtaatagtttatgctgtacagcataaactattcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48666 - DNA, 3352 bp, Homo sapiens
gactccggaagagcccttttctgcagctccttggggactgcacgtctcacttctaagtttgcggcggagagaataaagcagaaagacaggaagaggaggtggagttctacagttagtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48667 - DNA, 3169 bp, Homo sapiens
agtgagaaaaaaaagcaattcctgttaattatgtagacaatgcaagggtctccaggctccatttcagcaagttggtttcatcaagatcacgaaaagatgcatgcgtccccgagaccagagaggagttagggaccccgacacggaggtggcatcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48668 - DNA, 2988 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48669 - DNA, 2516 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48670 - DNA, 1342 bp, Homo sapiens
ttttttttaggaatgaatgcccactcacatttaataatagcttatgtagcacacaactctgcagcataataccaacaacaggagtgttttaaagcaggatggagaagaaagtagacaatacaacttaaggtttcctttgtcctttcccctgttttcaccatgagaattcagctgaaaaacaactctccagaatgcccacccatattgtcctttgacccaccacattccaaacttctgacttctgatcccaagctcttggagccttagcctttagtgatgtatccttctctgatgaggaaatcatagattttccgggttttgttcacatctatcttgatgagtgctcttgcctgcgccagtcttaagcctccttgctcctcgtgccgaattcggcacgagggcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48671 - DNA, 1118 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccacttcagattggtaacaccttcgtgcctgaatc

SEQ ID NO: 48672 - DNA, 412 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaactccccccacgttccaaacaaaagcttgccattttgacttggagatgcagcggtgggtcgagactcaagtcagatgcaaccgtgattattgaccttgcccttggcagtgcccaagatcgtcagagtgccagagcccgttctcctgtccgtcatcctgttcctgaagtaaaaggtgcagagaagaggtccatgtggactggtagc

SEQ ID NO: 48673 - DNA, 3158 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48674 - DNA, 1103 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcagctccagcacttgctggagcagatgggagccgcctcccgcgtgggcgtcccggagcctggccagctgcacttcaaccagttgggagctgaaagtgccgacagccattggtgccgtgttaaatagcaaagatgagcagagagcaacttgctgaacacaagcagaaacttgcagggcttccctatgaatacctctgctccaaaatgcaaaactgtaagtatctggatgaaggagacgacagcatgaacgacaaactgggccgactctccgggctgcactataaatggcccccggctgacgcacacattaggacatactgagcacgaggatcgtcgcaaagactccaagacagtgttcttacagggaaccccaagacgtccaattcccctaactgactaccggcccacaccagcggaacggcgcactatgaccccagcactcccctcacggcacgtgaggtacacccggccatgcctcggtaaaaacccatcacctgtaggcacactctcaggccaaggccgcgcccccgtcaattcatcgactccccgcaggcaaagccgccccacccagcgcacgaaaacacccccacacggagcgacccacgagccccccttcgcccatccccacccggaccccccccccacgcccgggcgagcactcgcccacccccgcggcaccccaaccgacgcgcgagccccgccccctgctcgaccgaacccgcgccccagccccgcatacccccacaccc

SEQ ID NO: 48675 - DNA, 3125 bp, Homo sapiens
gactccggaagagcccttttctgcagctccttggggactgcacgtctcacttctaagtttgcggcggagagaataaagcagaaagacaggaagaggaggtggagttctacagctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48676 - DNA, 2641 bp, Homo sapiens
atcgcggagtttcaccgcggacctgtcagagatacagaggttgtgggggcgggagacagaaagagagagagatccagagaccgagtcttacgttgacactgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaaccgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 48677 - DNA, 1926 bp, Homo sapiens
atcgcggagtttcaccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaattctccaaaggtttgaagtgatctaataagtaaagatcatttggttcaacggtggtcagaaaatattaggataggtggaaagcatattgggggaaggc

SEQ ID NO: 48678 - DNA, 388 bp, Homo sapiens
cgaagatgttagtggtaaacactgatgtggagaagtcttttatttctctttgtgttattgcaaacaattcctgttgactgaattgcaagattaaaagaaaaatcaaacacttcacagattccacctgaaggagagaaaatgcactgttgtgtaatactgtggttttcttggatgtctttagtgtcaacagtagctcagtcattcttacctcacttttactacctactaatcttaaatgtgaaaaaggagaaaagttccagcatcaatgtgcagcaggaaaaagaacaactgttgctccagtcattgttatacaacttactttctctccagagcccaaagattccaaaatagcaatacaaaagtgtgtttatagtcacccacaagtact

SEQ ID NO: 48679 - DNA, 437 bp, Homo sapiens
tgagcggattattagggggaatattatcattgctagtgtatcctttttatcccttaccttacttggggtatttcccatttttagtgtgaggctcaattccccttgctagaaatgtcttgcctatttttaaccctcaagataccccaaccagggaatacttcaccgccccacctcctccgtgtcttttcttaccttgatatgtcctgatcaaggaataccaccaccccctgtggcttctcttaccttggtctgtcccaaccaccaaggaaatactttgctggctcccaggcgtttccttcctcggtctgtgcacagagttgcctggtcactgtggtgtgtgaggatcctttcccctgggtcgccggctggtttctttcgacattgctgagtccaggtttatttgtcacaccaggtgagtctcgattcctgactcttga

SEQ ID NO: 48680 - DNA, 650 bp, Homo sapiens
tgagcggattattagggggaatattatcattgctagtgtatcctttttatcccttaccttacttggggtatttcccatttttagtgtgaggctcaattccccttgctagaaatgtcttgcctatttttaaccctcaagataccccaaccagggaatacttcaccgccccacctcctccgtgtcttttcttaccttgatatgtcctgatcaaggaataccaccaccccctgtggcttctcttaccttggtctgtcccaaccaccaaggaaatactttgctggctcccaggcgtttccttcctcggtctgtgcacagagttgcctggtcactgtggtgtgtgaggatcctttcccctgggtcgccggctggtttctttcgacattgctgagtccaggtttatttgtcacaccagtagttctggagcgaaagttcatgatgtgggtctccacacactgttctgtctgtccaagtgggagctgcaatctggtcctgcctgccgtctgccatgatgttcttgaaaaccaacaagtgcttcttaaatgctgacgtatcattttcccatgtctgagccaactcagcatgaacacaatgaggatgaaggcatttatgacgcccccacttcctcttaataaacagtttattaatattaa

SEQ ID NO: 48681 - DNA, 349 bp, Homo sapiens
ttctgttcaacatacacgtcctagctagtgcaacccagtgagtcacccacacgacccagcaatcctaccacctgtacaccccacggaactgaaagcagggagtcagagatctctgcattcgctttcatggcagcacggcacacaacacacagtgcaccgtacgcaacagccagaagaggaacacgtacgccagtatgtcgtggataagcaaactgcggcctgtccacacaacgggatgcttctcagccttcaaatggaataaaatcctgatacggacctgggtgaacattgaggaccttatgctaagtgaaataagcagtcactacagaacaagcaccgtatgactcca

SEQ ID NO: 48682 - DNA, 408 bp, Homo sapiens
cagatatggtggcctgtgactgtagtcccagctacttgggaggctgaggtgggatgatcgtctgagcctggggaggttgagactgcagtgagccatgatcaggccattgcactccagcctgggtgacagagtaagaccctgtcttaaaaaaaaaaagaaagaaagaaatattaattagaaacccatggttgaaacttacctgaatagaaggctttattttttttcataggtaagcctatgttttcttggatgtgaaactagggcactgggttgctcttaggtaatacaaggagatgaaatgcagcgatgcgatgatgagtgaagtagagcctgacctggtattgccattgcttcactgttggctttgaccagggtatgatctcttaatcttctctctgagctgattct

SEQ ID NO: 48683 - DNA, 319 bp, Homo sapiens
ggccactaagttaggtgtagtttgctacctggcaatagatgaccagagtggtgcatgccagtgactttacatatagccagggccatacatcccgatgttctggaaggatctggcacatgttggggacgctacctgatatgtgcagaggtacatttttgttgacactgagctgctcaaatattttcaccagcatgaaaggggattcaaaacagaagaatcctaattgtgtagccccaggggctctgggggtatgagggtatgaccccgggtttgcagttttgcctttaatccttaaaattcacttggattttgtattcta

SEQ ID NO: 48684 - DNA, 506 bp, Homo sapiens
ctggacatgatacatgcctgcccttcttgcttacatgtgaagtataaccaagtgccaaatgcttttataattgactaagcagccacacccaccctgctcagaaacagaaagctactgcaggcccctacaaagtgagtgagagtgtgtgagctcctgctgaagaggtgagacccagatcatagttcctacttgtttctctatgaagtggaaatacagaaaaagaagcaaatgtaagcataaattgtctatgttttaaaaacagttcagctcatgacttaaatttggtgtcaagctccttgctctagtatgtgtcctcagggtcaccttcatggcttaattttaagaagagagcaaaacagaattcagctttgatctgaatatgaatttagatagcagtgagcttggtgatgacatttctatatcattttctatatttcaaaggacagtgggaggatagaccttgcctttctgattaaagctgaatctaggccgggctcagtggctca

SEQ ID NO: 48685 - DNA, 108 bp, Homo sapiens
ttaagctcaacatcactactgatggaaaatcttggaaataattatttcagatcaggttttccaaccaggaacaggatttcatatttgagatataacatctaatgctag

SEQ ID NO: 48686 - DNA, 324 bp, Homo sapiens
aggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagt

SEQ ID NO: 48687 - DNA, 298 bp, Homo sapiens
ctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatg

SEQ ID NO: 48688 - DNA, 335 bp, Homo sapiens
taaaatgtaattgacaaaaattgtgtatattcaaggtgtacatgctatttttatatatggatatgttgtgaaatgatttccacatatcatattgtacttaacatagcacagtacctgatacatatttattgagtgaatgagagttttgactatgtaaataaagagactgagaatataaaataaaacattttacaactgtgaaaaggcaaggagaaaaacaggcaaactaatctctacccaacttaattttcatgttataaatcaaaaccctatcgtatcagatcaaggaaaggtgcttttctgtctcaactatttctcattctacctccatcact

SEQ ID NO: 48689 - DNA, 913 bp, Homo sapiens
gatgcctttcaggtgaaatcctggaacctgtctccaaacccccaagattatttaaagatcccaccactggactgtattcccggcccttggtcagtacttatttaccttcctacacgatgcctcttcccagcccgcccaccctcacacaccccttacctcccaatccccacagtctgcggctcgccttataccacccccccactctcctctctgtagaagcgggtacctttttgcgggacacttcgctggctgtgttgtttttgaggctttgggggctgagaagagcagatgaaaccctaaaatatttcatttaagagagtcttggcgaatgtgttttggccttggggtagcagatgaaggttatatttggcagttatattgaagcgattattgacccacagatggatctgggagagatgatcaggattgtattcgctcctgacgtacaaagcctgatgctttgacttctcagcagcccctaaccttccagcaatgggagataaagtgtgttctgtggctctcttctcttacactaaaaataatgattctcaggtgggttcagtcgtctttaataaaccagacagtcaagaaaagacaccatgccactttggaatctcaaaaacaagttcattatctccggctttgatatttgttcccagtggtggagcctgtgcagcggggtctttgttcacgggctaatgcttctcctaagcacctcgtgtgtgttcttcggcctcactgctctgtggcttaggtatctgtgctgtggggtttgagaaacatggtgaaggtgtatgaacagagcttgacatttgtggtgagataatgatttgcatgaataaggatgttcgtcgggccttattaagggccatgtttttggaatgtgtaacataatgttctctactgggtagta

SEQ ID NO: 48690 - DNA, 859 bp, Homo sapiens
gatgcctttcaggtgaaatcctggaacctgtctccaaacccccaagattatttaaagatcccaccactggactgtattcccggcccttggtcagtacttatttaccttcctacacgatgcctcttcccagcccgcccaccctcacacaccccttacctcccaatccccacagtctgcggctcgccttataccacccccccactctcctctctgtagaagcgggtacctttttgcgggacacttcgctggctgtgttgtttttgaggctttgggggctgagaagagcagatgaaaccctaaaatatttcatttaagagagtcttggcgaatgtgttttggccttggggtagcagatgaaggttatatttggcagttatattgaagcgattattgacccacagatggatctgggagagatgatcaggattgtattcgctcctgacgtacaaagcctgatgctttgacttctcagcagcccctaaccttccagcaatgggagataaagtgtgttctgtggctctcttctcttacactaaaaataatgattctcaggtgggttcagtcgtctttaataaaccagacagtcaagtgatatttgttcccagtggtggagcctgtgcagcggggtctttgttcacgggctaatgcttctcctaagcacctcgtgtgtgttcttcggcctcactgctctgtggcttaggtatctgtgctgtggggtttgagaaacatggtgaaggtgtatgaacagagcttgacatttgtggtgagataatgatttgcatgaataaggatgttcgtcgggccttattaagggccatgtttttggaatgtgtaacataatgttctctactgggtagta

SEQ ID NO: 48691 - DNA, 462 bp, Homo sapiens
gacccgtgtagcacccaccctgcctgcccagcatcagctgtgaagagacgggtgaacatccgtcagcctgggagagctctggcccagccaccaggtgtgtgcagagaaggcttgggcctactgcacagcctgtgtatccgctgagcagagcaaactggagatagctaagtcctcagctgtcctcaggtagagtctgctcctagacatcccccactaggaggaagctccacaatgccttttcagggtttcctgccagtgcctcatcatggatgtttcacagacttaatgagtaagctgactcttcaggctgcaaggcagcaccaggccctgggcagcagcctctggtcaagtcacagcccaaccctggggttcccgtcttagctgctgtcagatttcaaggccattgccctgctacaagtaagagcataaggaattgtgtccaccccttggcccaagaaacta

SEQ ID NO: 48692 - DNA, 1883 bp, Homo sapiens
ctggcacgaggcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatctgttatttaaacttgcagtttaaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcacgccattctcctggctcagcctccggagtagttgggactacaggcactcgtcaccacacctggctaatgttttttgttttttgggtttttttgtatttttagtagagagagggtttcaccgtgttagccagggtggtctcgatctcctgacctcatgatccgcccaccccggcctcccaaaatgctgggattacaggtgtgagccactgcgcctggccgactcttgtctgtttgaatgcaaagttctcaatagtggtttttgtccataagtattaacttataattttggagagtgataggtatggttgctggttgattagcaataagattatgtagccttaaactagctagaagagtttgcatgggtgaggcaacaggctgttaacaaaaagaaactggaaatacagtttcccctgtttgtttctcctgtttgtacaatctgctttaaaaacaagtgaacatgcaccatgtcagtcatggtgaatcggccaacagccagcccttgccagttgacatcacagtctaagatgggaaactggtacagatagacatgaagagagcttagcagtggttgaggtggtgactaaatatacagtcattgaataaataccgtgtagcaaatgtaaaaaaaaaaaaaaaaagtaaagtacaacagaatacaaaagtgccatttaatattttatagctatttctatgcacaagtgctggttttaaatttatataaaagcaaagactgtttctgtgttttcttccagagtatttctgttacagccatagaagtaaagttaataaatgtaagactttttttgttttgttttgtgccataaatgtaagactccattttgtctgcaactgctaagtgccactttccttttattatgggtagggatgttgctaaggatacttaagtagttaagagcaagatgaaagaagttacagattattttctagttggctaatctgtgttgaatacattttttatgatgatttttattgacaccacaggacctcagcctgtatatattgataatgtaaccaaagctgctcaggaattggggtaatttttcagtcaactcagaagttaacaggaaatccttgttacacattcttaaattttagataagtgcaagaactattaacaaaataacatt

SEQ ID NO: 48693 - DNA, 963 bp, Homo sapiens
ctggcacgaggcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatctgttatttaaacttgcagtttaaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagagcgaggctccgtctcaaaaaaaaaaaaaaaaaaaaaatattgttttagcgctgggtttcccaaggtgggagagacagacccagcctggagctggcccctggctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgat

SEQ ID NO: 48694 - DNA, 781 bp, Homo sapiens
ctggcacgaggcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatctgttatttaaacttgcagtttaaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatgaacctgggaggcggagcttgcagtgagccaagattgcgccactgcactccagcctaggcgacaaagcgagactccgtctgggaaa

SEQ ID NO: 48695 - DNA, 371 bp, Homo sapiens
agcaaaacctcaaggagaacctggctaataagacctccaatctgactagaatccctccccaccccacctccttgtaaagaaccagcttctgtaatagtatcctacagaaccctcccaggtttgagcggacaggagagccggagagaagccctgatttggtcacatggtcctacctcagtaggaagcagctttgctcttttacaatttgttacaggcccgagcaggctcttggagcacagccttggggttgtcctgacagtcctggtgggctcagccaggggcagtacttcttgataatacctggaagggttattttaggtggactttcagagactacaaaaaggattaggtgaaaataacaacagctgtta

SEQ ID NO: 48696 - DNA, 408 bp, Homo sapiens
gaacttgtagtttgcatagtatccgacagatgtcaccgtatttaccttgaaaatttaaaatattttgcagcatccttgtgaatttgatgtgataccccaaggcacctgagcacacagtttgggaaccattgccttggaatattaatcatagttacctccagagagtgaaattttggataattaaaaaaatttcttttttcttgagatggagttttggtcttgttgcccaggctagagtgcaatggcgtgatctcggctcaccgcagactccgcctcccgctttcaagctattctcccgcctcatcctcccaagtagctgggattacaggcatgcaccaccacgcccggctaattttgtatttttagtagagacggggtttctccatgttggtcaggctggtctcgaat

SEQ ID NO: 48697 - DNA, 322 bp, Homo sapiens
caattacgtcatctggatagacccagaaacatgatactttttggttttctgtagccttggtgccattgttgatctttattaattatcattatcctcaaaatagccataatgtgctgagtctcttcctatttgctgggcagaggctgagtatttcagcgagctcactgagtccttaaaattgcattatgatagagagaaagagattattatttgcattttgcaaaatgaagaaattgaggtttagagatacccaagggccacgtgagtgtgagtgcctggaattggagcctaaatctagtcatctgatagcaaagcctgtttt

SEQ ID NO: 48698 - DNA, 553 bp, Homo sapiens
agaggatccccgctttataccatactgaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagaggtgggatgtagtatgataacactaggaggagggaaaacccgggactatgaaacagggcaattgctaggtagaaaagggagtggagttgcgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtaga

SEQ ID NO: 48699 - DNA, 831 bp, Homo sapiens
ggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagaggtgggatgtagtatgataacactaggaggagggaaaacccgggactatgaaacagggcaattgctaggtagaaaagggagtggagttgcgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtaga

SEQ ID NO: 48700 - DNA, 325 bp, Homo sapiens
attggtaattaactgcatttaataaagcaacttcctttatctcttaagttgctttactctcattagaacattagtagcagctcattagaacaattgttttctattgctgactggtaatttatcaaagaggagagattggtctttatgtggttatttacttttcctgattactttttgggaaattgtaattaaatcaatgagtggcaataaatgtaaaattacaccctcaagttatctatccttaacttttagcactcacttgaggagacacattttgcctttgagaattgttatttttttgagatagggtctcactctgtcaccc

SEQ ID NO: 48701 - DNA, 843 bp, Homo sapiens
acttaatatcactgttcaggaagaacttacataaacaggaacatctcactttcctaattcttgacccaaactcagccttagtgaagcctcttctcttcacctagggagaatgtggaatcattgtccagaaacccctgacccttcagctttccagcctcaggacaaggctcagctcctgcctgcctgttctgagagttccttgttagcatgtgctgaactctttgcaggcctgtcgtgcagtttgtgggattaatcttgacaaatagaattacttttgtattttgaaatctattaaattcaaatctgttttttaatattgctctcaggacagaattaatatgttgtgtgttagtaataataagttaattttttaaagcatgtggtcatttaaaatggaagatatatgatcactaattatatgttaagctggaggatggtgttttactaagttattttcattgtttaattatgggtgattaaaatgtattgtggaggtacatttttaaatatgtctttatatttttcatgaatgtagaaatcatctgagcagggtcagacttttaaaatgttatcataatggtttgccagctgaccttaggcaaatcagaatctctgtgaaagttattttcttcagttttcctctgttaagtaggacttcccaggcagttcctgttgaatttgggggtatggattttacttaaggaaagtcattgatcacagaaatgaaactgggatgatattttttcgagataataaagggagggggcttttgccttttaaatcaggagacagtggtagaaaatggagcaggaaggggcctgaagcaggtgcgttggtctcatg

SEQ ID NO: 48702 - DNA, 479 bp, Homo sapiens
aagaaacccaaatgagatgggtcgtaattgattagtggaagttaaatcatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagatagg

SEQ ID NO: 48703 - DNA, 244 bp, Homo sapiens
aaagggaatagttttctccccctgcaatgctcagagtgcacttgggaaaccataagcaggtgattatcattgaggctttaggaggtacgttagtttcctgtggctgctgtacaaagtgccacaaactgggtggcttaaaacaacagaaatgattcctccctagttctggaagctggaagtgaaatccacatgtcctgagtccatgttccctctgaagctcttgggggtgggggatcctttctct

SEQ ID NO: 48704 - DNA, 275 bp, Homo sapiens
cctggttttgtgaacccatctaaaataaaaggctttcctaaggcagaaggaaaaaaaaaaatcactagatttagggcatgttctgagaaagcactccctagaggcagtcatgagcaagacaagtgttttccaagtctgcttctcagtttgcccacatcagaatcccctgggatgctcatcacaaatgcagatttctgggctcagtcttacagaagtgtctggataggagcccaggattttacgtcacaacagggtccccaacttatgcacacaca

SEQ ID NO: 48705 - DNA, 290 bp, Homo sapiens
ccgtctctactaaaaatacaaaaaattagccaggcatggtggcaggcacctgtagtcccagctactcgggatgctgaggcaggagaatggcgtgaactcaggaggcggagcttgcagtgagccgagatcacgccactgcactcaagcctgggtgacacagcgagactccctctcaaaaataaataaataaataaataaaattaaaataagtaaaaggttgagaattaagaatgttgttttctcattaaaaaggaacaaacttactactgggtctacattttaataatcga

SEQ ID NO: 48706 - DNA, 262 bp, Homo sapiens
cctgcattcatttagatgcctgaaaaaagcaaaaagcctccttttggcagaaatggggagaacattttggaaatggaaactctttgcatgctccattgacctaggcttggcttctgccatgtttaccattggttcagttcagtccagtctcaagcatacttcagaattagcagttcttctctatctgtagtttattagtatgttatttccatatagttcaagatccagtgaggtagaaggtaaagaatggggcaaagaaaga

SEQ ID NO: 48707 - DNA, 406 bp, Homo sapiens
tctgtgcttggtagtttataccactgagtgaataactactgagtttttaagattatgaaaacacagcaattgcatattgccttgaggcggtagcactatctaaaaatttacagcactaggttcagctgaatgtttagtccaagacaaagttctgccttgttgaaattttctgttttgctttatctttaacattttccttcaccaaagtttttatctcctcggattacttttcccctgagaaagtgcataataccaaaagggaatagagtgtctactaaatcaagttaggtactgctggaatatttggtattttctttccctaattaaggaagcagtattaggagcattacctctggagtccaggttccctcagcctggacctgcacttcccagctgggtgattttg

SEQ ID NO: 48708 - DNA, 357 bp, Homo sapiens
gacaggttcagctggggctatccctaagaaaggctacctgactcctctccagcatattggtctcagggtagtctgtctttttacatggcagctcagcactccaagagcaactgcttcagaggacaagatagagtggtttggccttttatgatcaagtctcagaagttacctagtatcacttctgtcatgctgtatgggtcaaagtagccacaagcacacgtagatttaaggagaggatcccacctaccaatgagaggagtgtccgagaattgtggccattttgttcaactgccacagtcctctttcatggcaccttttgtttataatgccttaacacctcttgtaactgttccttcc

SEQ ID NO: 48709 - DNA, 260 bp, Homo sapiens
ttaacatattaagtaagcatagttgttttttactctatatccaatcattccaatatttaatgtctatgtagggttgattcagctgcttagtgtttctgatgattcttattcatagtacttcatttccttgtagcttttcgtgttcagtggtaaataatgtatggtatttctttgaattttaggacaaagtgaattcaccagagaatctgcatttgttttggtcagttgtccgaacgcactatccatcatagactacttta

SEQ ID NO: 48710 - DNA, 417 bp, Homo sapiens
agaataacggctgtgaaggagctaggaaggtagaaaaggcaagtcatatggggccttgtgcacagttctgaggagtcggacttggtcagatggggggttggggatcttaagcaggcaggaagtgatgagattagaaggggcacagtgggccgggcacggtggctcacgcctgtaatcccagcactttgggcggccgaggcgggtggatcaccgggggtcaggagttcgagaccagcctggccaacatggtgaaaccccgtctctactaaaaatacaaaaattagccgggcatggtggcaggcgcctgtaagctacttggtcggctggggcaagagaattggttgaacctgggaggcagagattgcagtgagccaagactgcaccactgcactccagactgggtgacagagcgagact

SEQ ID NO: 48711 - DNA, 379 bp, Homo sapiens
ttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttatacca

SEQ ID NO: 48712 - DNA, 2613 bp, Homo sapiens
acttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatcgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggaagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggcccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgcaatgtagcgctattctactgaaatttctttcttctcttttctttacaaaatcataaagaaaaaattaattcattacttatatagtaggtacaactcagcctacaaactctaatctgcaagaagcataactttatttttctaacacagaatgtaatttctattaggaaccccgtttcagcaggtggtagaaattaatctcagtcaattcaaagtctccccctgaccttttcctggggttaagctcggtcgggtgggggtgtggctttaagtcatgtaagactctgttcctcggctatcatcatccgtccatg

SEQ ID NO: 48713 - DNA, 455 bp, Homo sapiens
tgaatatggaaaagagttagacgaacgatgccgacgagtttctgaagctccttccctccctgttgtgttcattgatggccattaccttgggggtgctgagaaaattttgtcaatgaatgaatcaggagaactgcaagacatcctaaccaaaattgagagagtacagcatccacatgagtgtccctcttgtggaggctttggctttcttccatgctccgtgtgccatgggagcaagatgtccatgtttcgaaactgcttcacagactctttcaaagccctgaagtgtacggcttgcaatgaaaatggtcttcagcgttgtaagaactgtgctggttaattggagcttctacccaggaaaaacctcattttattaatcaaaggcaatactttgatttatatatatatttttaaatggttatgtttatggattaatcaataaactttgtttattataa

SEQ ID NO: 48714 - DNA, 859 bp, Homo sapiens
tgaatatggaaaagagttagacgaacgatgccgacgagtttctgaagctccttccctccctgttgtgttcattgatggccattaccttgggggtgctgagaaaattttgtcaatgaatgaatcaggagaactgcaagacatcctaaccaaaattgagagagtacagcatccacatgagtgtccctcttgtggaggctttggctttcttccatgctccgtgtgccatgggagcaagatgtccatgtttcgaaactgcttcacagactctttcaaagccctgaagtgtacggcttgcaatgaaaatggtcttcagcgttgtaagaactgtgctggttaattggagcttctacccaggaaaaacctcattttattaatcaaaggcaatactttgatttatatatatatttttaaatggttatgtttatggattaatcaataaactttgtttattataaaatccccaatatatatttagctccttgattgcccccaccccccattctcctctctctcgatccccccgctctccctcccccctcccccccataccccccccacccccccctttcatctctcttcccatgttttcccccttccccccccatcgtttctttcttcctccctctctcccctccttcttctcaatctatcccccgtacctcactttctctcatataatcactctccctacatcacgcccccctcatcccttaccacccttcccaccctattcccttcccccacatccgcccccctctttctctcgccccccattcttccattcctccacccactcccccatactcatctcccccccagacgcacaccatccacttcccatctcgaatctcgtacacag

SEQ ID NO: 48715 - DNA, 412 bp, Homo sapiens
gaccccctggtttggtccagccttagagcgggtttgcaggtagacaccttcctaatgtttgttccacgtaagcccccggagcacagtatttccatcagctattttgtggaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaaca

SEQ ID NO: 48716 - DNA, 495 bp, Homo sapiens
ctgaggcggcgtgggaagcgggcgaccttatctctgctcagctggaaaaaggcccagggtaacaccggaagtgggcttatttgcgcatcagctactttcgcttctacttaaaaacggaggatctgggtaaaagaaccgaaaggctgtacgaacctaagacttgtctccgatgtccttctcaaccatcaatttcatatgcgagggaaaacacctgctgggttcacgcagaatataaaggtctttgaaataattcttgatctctaggccaaggagttttacattttaaaataatcaagcgtgcctactgcttgccaggccctgctctcgccttcactcgcattattcaattaatcgacacaggcctgtgcagtgcgtcttaatgacaaggactcctaccctccactgcctgtgttggaatcctggttctgccagttattagctgtgtatcctggcctaagttactctctgccacagtttctgactctgtaaaatagg

SEQ ID NO: 48717 - DNA, 2826 bp, Homo sapiens
gaatcttcctagttctagtggttggacaagtctttaactccatagcctagctccagctaggttcatgagctggccctactgctctctcctttccccttttcctcttatcccattgcattagtctggattcttgcttacagataaccaaaaccttagtcaatctgatttaagcaaaaaccagaattgataggctcacataactgaaattccagggtagaccctaaggccgggctggatgcagggactcagtcatctcactcgggctaggtctctctcaatgcctagtccctatttcatctgagttggcttccctctcaggtgggctttttctcatggagatcctcagcagcccatggaaggagagtctgtttttcccatcatcttgtacaagtccccaggttgagtctcattggcctgctggccccatgcccatccctgaacaatactgcaattggtcacctgcagtcacatgccctgtgactgcaggaaggtggggatgggctagttacccaaaggaaagtccaggtgctgtgcccagaagggagaatggatgtggggcagagcaaaccgtagatgtctaccttacccagccagacaagactgcatgtaagaaccaggcttacgggccagcccctctctgcaggcccacactgtacactcctgaaatgccattccttagtctggccaaccctcattcacccttccaatctcagcttatatagatggctccccatgctgcctaggaactaccccacattgcactcccatctctgcatgctccctggaggcagggaggaggttttgtccacctctatatccccagtctctggcccacatcagtgttttcagtaagtgttagtgtgttagtggcatcacttccaactgatatacctccttggtactacccttcccagacttaggaggccatctttggacaatggtgtatggtgggaaagtgctcagcaaggaggctctccttccatcctaggaccctgggccagttgtttcacctccggtcctcataccccagactgtgctgatacggttttccttcctaccccacaagataggatcaaatgagatgctgtgtggaaagccctctgacatacacagatatgaggggttgtttggattaggggtggaggcagcaggatgagcagaaaggaaactgcacagtgtccccaggaggccatggttaggttatctccaactatgagatacaggagacagaaagtatccaaccaggacaatgtgaccaaactaaagtgagaaaaatgtaggctttggggcagtgtaagtgggtatatcttctgtgaatagcaatttggcaaaatccattacatttcagagcaagcacattctttgacctgaaattccatgcccaggagtttatataagagagacagtgatgagcaaagatttatttgctgaagtgttacttaccatagcagaagattgaaaatgacccaaatgcacgtcctttggggataaataagttagagcatatctaaacaagaaaatattacgtaaaataaattggaggtctccacaaaaaaaaaaaaaaacccattttttttcagacaggatctcacaccgttgcccaggctggagggcagtgacgtgatcagagctcactgcagcttcaacaccccagggctcgagcagttgtcccacttcagcctcccaaatagctgggactacaggtctacaccaccactcccggctaattttttaatattttgtaatgacagggtctccatatgttgcccaggctggtctcgaactcctggcctcgagcagtcttcctgcctcgggctcccaacatgctggcattacaggtatgagccaccgcgcccagcccatctcacttctgaaaatgactcagtgccatgaacccttcatccctagtggcctttgggggtgggaggtcttcaaagtacagccgtctctttctacctaatgtgtgtctgcaacatcgaacttgttcatcataagtacgtattacttctgtaaccaggaaaagttacaagaagagggggccaggcacagtggctcatgcccgtaattctcacattttgggaggtcgaggcaggagtattgcttgagcccggaagttcgagaccagctttgggcaacacagtgagacctcatctctaaaaaaaagttcttttaattagctgggcatggtggtgtgctgcgtgcctgtggtcccagctacttggaaggctaaggtaggaggaggattcctttagcctggaggtcaaggctgcagtgagccatgttcatgacactgcactccagcctgggtgatagagtgagaacttgtctcaaaggaaagaaaaaaaaaataagaaaatgttgggttctcagcacttccagcccacccccatccatatacattccagcacattgttggggccatttgcaagctctgagatgagattctgcacaagtcagcagtgcagagactcccagggaaggcctgaggccgccaagagcaactctgcagggtctgctccaagaggcagaggtgggccccaccgtccttggcaaaatggagattggtctgagggttccatgaggcaggcttgcaggagcaagggagtgatagaaagccatgtgaggggacgagagggaggacaccctcccctgcagaagtcaggaaggtctttgagcttgttctgagaggaaaacccattctctgggtagaggaatgaagactcagaggagactggggttcgctttgtgtgatactgatatggttactgaaaggctagcccagtcccaggctacgtgaacagacttaaaaaaaaaaaaaaaaaaact

SEQ ID NO: 48718 - DNA, 416 bp, Homo sapiens
gcccctgctgttccactctgctgcccctctgccatcactctgctagtggagcttggggttttttatgggtacaagatgggaggcagggagagccaaaaagcagcatttgagtgggaaaacaggaatgcatgttctcactttgggccacagtacccaggcctaagggtgtggccctcaccagggactgtcctcttctacccgggatttccgtgtctcctgtttgtatcagtactatgcagttcttttctctttaaaataaccctttgatggggggaggggggagggatagcattaggagatatacctaatgctaaatgacgagttaatgggtgcagcaccccagcatggcacatgtatacatatgtaactaacctgcacattgtgcacatgtaccctaaaacttaaagtataataat

SEQ ID NO: 48719 - DNA, 848 bp, Homo sapiens
ctaccttgccccacaattggcagagttttgatggaattcctaccaaatcttttaccttgcctccttgctgttttctttagtatattaaaattctataacctttatgtttagtactttgtttgacttggtgaacttaatttgcatttatgccattatacctcctaatttttagtgaaattcaaaaagacctcaccaatcatactaacaaggtagagggaaaaatccatgattaattagcttaaaaaagttttaaattatagggatgttaaagattcttatttttaacttttaagctagagcaaaatatatttatttctaggatataatgatttagtgactagctaaaagtggttttaaatgaacgttttgcagtatgaatggaacttaggtattttttaaagcttcttggtaaatgaaacctttatttgaataactgcaaatttctccctcctataaggacagtggcagagggtggacatgatatatctggattctggtctttacctacaattttcatgcagagtttgtcatgaacagctgctgcattttttgtaatctaattttctttactgctttaagtgatccaagtgttactcccaaccactgaatgattgcaactaaaataaaatgaatggattaatattgaaaagggaatattaaattttgatcttaagcacacctgggtatcagagatgaggacaactcactattttaagtcttcttaggattagtagagtacccctgtttattgcaaaggaaagttgaaaaggatgttaatagcatgtcaatgggagaggtggggactatagtatagagaagtaaaaaagttatcttaaaggtagctttta

SEQ ID NO: 48720 - DNA, 365 bp, Homo sapiens
acacttcctctggtgtactgggcactgtgctgggtagtataggagttataaacaagaaatcaggctgggtgcagtggctcacacctgaaatctcagcactttaggaggctgaggcgggtggatcacttgagcccaggagtttgagaccagcttgggcaatagtatagtgagacctcgtctctactaaaaacaaaacaaaacaaaaacaacaacaacaaaattagccggacaagcgcctgtgatcccagctacttgggaggctgaggtgggaggatcgcttgagatggtcaaggctacggtgagttgtgatggcaccactgcactccagcctggatgtgagcaagaccctgtcttgaaaaaaaaaa

SEQ ID NO: 48721 - DNA, 395 bp, Homo sapiens
  misc_feature (1)..(1): n is a, c, g, or t
nccgagtggggcccccactcttccctttgccccggatgagtgttctctgacaccaggttccccgccccaccctctaaacaaacagaagcatcaccctccccacccttctcaaacccagaaggatctggtgcccaggtcacctcagctggagaaatccagaatccgcctacggagaacactgaggaaccttggtggaggcaggggtcagaggggacagtgacatttgagggccttgggggaaagttagcctatgctgagctgaggctctggctaggggcccagtattggctttgctatttcctggctgtgagagcttgagtgagtcttccaacctctttgaacttcaggttttcatctgtaaaatggggctgatcacagaatttgcttcatagggc

SEQ ID NO: 48722 - DNA, 383 bp, Homo sapiens
agaatttattacagcaaaagggtgtaaagcaaaatcaccaaagggaaaagactcatggggcagaagtccaaagtccaaagttaggcagtccagagttaggcagtgggtgccctggtgaccagcccccaataaaaaccctgggcactgagcttctaatgagcttccctggtaggcaacacttaacacttctcacaaaccatggctgcaggaattaagcatattccatgtgacttcactgggagaggactattggaagctttctccaagccagggagaaagccaggtactcactgcctagcatgtatcaaaatttctagattcccagaaggaaagcagatgttcaccataaatcacactgtacaacagtttaggcacaatgagcc

SEQ ID NO: 48723 - DNA, 314 bp, Homo sapiens
aaataatgggacttctgaggcaaggtcatgaaagcactccacctggggtctctctctctctctctcagcatgctccttggtagttctgagccggcatgtaagaagtcggccacagagaggtagagaagcccagggagtcccagctgtttgagtcttcccaccccaggcatcagacatataagtaagtaattcaaatgatttcatcccccagtttttaagctgtcccaggtgacaccaagtggtacagagacaagctgtccctgcaaagccctacagattcaataaatgtcatggtttaaaccactaagttttgg

SEQ ID NO: 48724 - DNA, 760 bp, Homo sapiens
taaatcagatttgtaaagtatgtaatcatgaactcctggatgatttgagtcagatatttattcctatttccatctaaagcaccaagcacagtacttgaaaagtcacatggatttatcaaatttcaataaatttaaattagaacatgtctttatcctttaaaaattgaaataatactgagaaatacctcccttgagagcctggtatgctaaaatcttgctactaaaagccagacttagcttaggtcactgataactagaaactcatgcagataatacaaattgtactttttgcttattttgatctattttttaaagtatgtatctaatgagcttcaaagcttaagttttgtttctttttgccctaatggaatgatgagtggcagagcagagaagttaaaaaggatgtttgaaagctataaaacaacaatttggatgagatagatgttgtatagccttgcaatattaactttgaattggtctgattagaacaaacctaggaacaaacatattccttttctcacctcttaaatttgcagctaaatctacaatattatgaccactgactaaagttgtctatggagaacctggttagcaaacattaaaaaaattacactattttttctcatcattattcagcagtaaacacagaaggcagtcttttaattatatttagctagactgacaatcttgagattaaagaccccctaaggagttctcatcattttccacctgaaagtagaattaaaagtaaatacttaca

SEQ ID NO: 48725 - DNA, 325 bp, Homo sapiens
tggggacgaacttctagccaaccttcctacactgccaggatatccccttagggacctctgccactcagaaagggcatgctctgatcatttactagagctgaggtgaacctggcgtaaagacgccacctagagctgaaaagaagacagtccatagcaataaagaacctttaagcaattgtagccaataaaaatcaaaacaagccagacagagaagactggaataaataattaatccttcaatgtaaagacatagacatacatccacaagaaacaacagcaaacaggaaaccaaggtctccccaaatggacaaaacaagaaaccagt

SEQ ID NO: 48726 - DNA, 303 bp, Homo sapiens
tgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacct

SEQ ID NO: 48727 - DNA, 476 bp, Homo sapiens
tgggggtaaaactttggaacgtgttcaaagcctagctgctctagtaatcctctctcctcttctggagtggaagatattggaagtctgagaataagcaaagcatgcagattatgaagctgaggggttataactatttcatttattgaaatatatttcaatgatattcaacttgctcagagagaatccgtgagctgtattttaaaaatcaatacaggctgggcacggtggctcacgcctgtaatcccagcactttgggaggccgaggtgggtggatcatgaggtaaggagttcaagaccagcctggccaagatggtgaaaccccgtctctactaaaaatacaaaaattagccaggcgtggtggcgagcgcctataatcccagctactcaggaggctgaagcagggaattgcttgaacccttgggcggaggttgcagtgagcttagattgcgccactgcactccagcctgggcgacaga

SEQ ID NO: 48728 - DNA, 261 bp, Homo sapiens
gtggaaaatcagatcagatataccttgaaaagctcactcagcagatagaaaataagaataaggggatggggaagggacaaaagggagtatgataaatatggagggctgacaaaaatacaacataagaaaaatgggttttctggaagaagagtaataaataaatgccaataaccaaagacataatatagcaaaagaaaacttcattccatcaaagaaagacctaactttgcagaacaaaatgtgctgttgtttaaccaagta

SEQ ID NO: 48729 - DNA, 384 bp, Homo sapiens
ggaaaataatggtttcttatatacctaaatcattaaagttcagaaaataaactgtgggtattctttttacagcggtctttgaatagatttatttactatcatcccttgatctcatttctactctttttacagttctaacattttataacttttgagttccactcgtggaataagatattctctttactgtaacaggttctttggagatttgatgggaataaaccagatgccttaggtctcaatactcggctgtacaggtggataccccagaatgaccttctaggtcatccaaaaaccagagcttttataactcatggtggagccaatggcatctacgagacaatctaccatgggatccctatggtgggcattccattgtttttt

SEQ ID NO: 48730 - DNA, 410 bp, Homo sapiens
gatacagcacagaagcatcctggctaattcccatttgttgtcctgccagcaaaagcaccatcgtttctaagcataagaagtgagagaaggcaatttgtgttgctttgtttatgcaggacaacccttaagccagttgtggcatgcaaaatacttaagagtgaatgcgtatttccacagtggttcagaaagtaaaagatggccatatacacccgatgattctaattccatattatgcttgtgaggcagtgcagagactttcagaaactttaggaagtgatcctaaactcttcacactctataaactgaagcctaccctaatgaagctccacaaaggacgttgatcttatgctcatttcaaattggccatgttttctaaactgtagtttttcctatcagctgtatatcagacc

SEQ ID NO: 48731 - DNA, 866 bp, Homo sapiens
ctcccaaagtgttgggactacaggcgtgagccactgcacctgacttaatcttagcattcttaatgaagacttacagtacataagccatgatttttttggtcaggcaatcaatagttacttattagtgtctactcaatgcaaagcacctttcttggcattctggagaaacaaagagagattataatttagggaaggagataaattaaaaggttaatttaaaaaatgataagtgcacagttgaagagatgtcacaagccaagaagactggcacaaatggtagtgctaaaggagttcttggtcatggtgccatgtgcctgtaatcccagttacttgagaggctgtgacaggagggttgcttgaaccaaggtgttcaagactagcctgagcaacatagcaagtcccgatctcaaaaaaaaaaaaaaaaagttataaaaaaagataggttcaaatcctagctagggaaaaaaagatagaagtcactagactggcatattctacaaaagcataattgctagactttcttatgcgtcctgcctttgtaactgctgttgcctctgcctgatctcctttccacctactctttcccacaaactaattcatgtgcttcaaaactactatttttttcgtatcatttctaatatggtgcttgatgcctagaacatgtagtcatctatgtaatgcccattcccaacaaacttccaagcttttgttaatgctggaataaattaatataaacctaaagtttatgaattagtataaacctaaatgtctgaaaataatagacatgtagtattgtattcttacctcaaaatatgttgaatcttgccaacattaaatcaacactggtgttcttgcctgttaattct

SEQ ID NO: 48732 - DNA, 830 bp, Homo sapiens
ggtgagagaggtttgttgttcaggaggagaacgaagaaggtgtgaagaccagcctctgtggatactcatcttcatggcaacttcactgcccccaatacagaattatttgctttttataacacctcagcctcctttaccacagccacaaaaatgtcagactcacatttcaatcttagatcactacttcctggcttttcggccctttctcactctatacaccacactccacttacttttcaactttaccaagacttctagtgcctgatccctgcacttctactctcaggacattcctggcgtcttttcctttctgtgcttaacctagaactctatggataatatcccaaatatcatcaaaccggcattatccatggcctcatgctctctaccttctacttctgctggggccagcctcaagggcatgagaccatacacccacatagcaccacatcctcagaaggtggccctcatcagtggcttatgattttctactcataatcttaaaattttgtataactgtctttgcatttgtattttgctggtgaagtccaatgggtcaatgaacatgtgtcaggggctgggaccctctgttcatgcatggacctacctgccaccacctgttcaccaccttgggataagtttttacctgtctgctccctcacctctactaaaaaaatcactgctgcccttcacctgcactgaatcctggagaaacacacaagatgatcgaggttgggcacctgcacttcaagtcatgagctatgggtgtctacaccaacctcaagagtaccctggagccacagggagcatctcagcaataaatggccaat

SEQ ID NO: 48733 - DNA, 861 bp, Homo sapiens
cacaatcgtggtagaaggcaaggaggagcaagtcacatcttacgtggatggtggtgggcaaaagagagagagcttgtgcaggggaactcctctttttaaaagtatcagatctcgtgagatttattcactattatgacaacagcagaagacagacctgcccccatgattcaattacctcccactgagtgcctccctcaacatgtgggaattacgagttatacttcaagatgatttgggtggggacacacagccaaaccatattagggagcaggaaaaagaaacaaaaacagcaactaataactcccaagaccacagcttcgctcctgtctagagctttgctacttagccacaggaacacgggtgatcatacctcaacagaagtctgccagcattcattacgaccagtgcttaatctcatctgacaatatcaatgtcaaaatcagagcttggagctggcggtgtttcagcagaggagtctttggagcttccacgaactggttcaataaacaatcttgctgtgaaacacagagcttggtatttagaagggttttagctggcatatccacaaagctgcagcatcctgtccactgctaattccactgtgaaatgttgaaatacagctcttagctccgagaaagcatgtaggcttctatttgcatgcaaatcattgccattcatgtgtgaactacagcaggtaacagctctgccagatggaataatttggggtaaggccatcctctttgttaaaggccacaggtatccatgcatgctgcagtgtagctcattcctactttccacgtcaccccctggggaataatcattttaatgatgggcctcaaggaaaggaaacgccattctacc

SEQ ID NO: 48734 - DNA, 311 bp, Homo sapiens
attgactctgtgacatcagatgtgctggagactgttagtgcctggagcgtaaaggttttatcacggggacacagtatggtgtattgggttcaaaccctggctctgcctgttactgacctgtcattctttggcgtaatactaacttattaatgcttagagtccttccatgcaaaataaggacaatgttagctatttcacaggtgacatgaaataacctaggaaataaaatcagatatatagggtgcctgataaatggtagcctctcaatcatttccgtttccccctttttgccttcacgttttgtcctgttt

SEQ ID NO: 48735 - DNA, 282 bp, Homo sapiens
ctttgactctgagatttatcttcaaatgctgatgcattctaagatttatagaagtacaaacttatcttattattgctaatttgtcccattactagactatgccccttagagttataattatgactagcccaattacattttattgtcgtgcccttttttggcaaaaaataaaatttctttgttaaactcaaggatttaaaatttagcacaagttcataaacttactttgatacttcttcatttcctttttaaaaatacatcagtagactcaaaatgtaaaag

SEQ ID NO: 48736 - DNA, 313 bp, Homo sapiens
ggtccccaccaagctgtccttggataggagggacgcggaggtggcaggcacttgtaatgagcagagagctcgcccaggcaaggccggccattgatcgcctggctcctgacttgtttcagcagcaagggaggagggagagggagtatgtgtgtccccaggagcagcatgcaagtgtccaggcatcagcgtgaccctgaagtagagatggcggggggtggcaagggggatggccagaggcccccaacccatctgtgctcagcacacatgagtgtgccaggtgagttccaggtacttggcattcgtgatctcctgt

SEQ ID NO: 48737 - DNA, 679 bp, Homo sapiens
agtgtggtttttaaaagtggtatctcttcagtaacttttgaggtaattgttggcatagtggtagttgctaaaactgtgataaaaagaagttaagagaaactgtgtgaaagtaagcctgtcacacatgtataaagaaggttagttccccaccacctcagggccagccccaccctaaggctctatccctgcattagagcctggatctgcctctgccacagagtcacactgcacacacatcattggattttcagatttctgtagtcatccagtcaaagcccaggacttcttccccaagccttgagtttacatggtatttagaaataggtgtaaggtttgctgctttcaggcacagtggggcttgtcgtttactcagcagctgggatccttctgttcagagtactgttttgcatgggattctcagagaagtagatttttctccccaaagcaaccaataggatgattaggtctattaactggtaactggcaaaatgaactccattgtcagagactggggacggctgtgattgcccaaccagcagaagaagcctcgattgtcattggtttataatgatgaaaggggaagagaaagagagtgtctgattgtttttttctaaaggaaacttagtggttcgatttgttgaatgttcttcagggatagccttagagaagcaacatgtgt

SEQ ID NO: 48738 - DNA, 601 bp, Homo sapiens
  misc_feature (17)..(17): n is a, c, g, or t
  misc_feature (34)..(34): n is a, c, g, or t
  misc_feature (40)..(41): n is a, c, g, or t
ttggatacttcctcccnggaaactggactccagntcttcnngcttgggactgggctggcttccttgcccctcagcctgcagacagtctattgtgggaccttgtgatcgtgtgagttaatacccgaataaatgcccctttctatatatctatcctgttagttctgtccctctagagaaccctgaccaatacagggtccgttccttaccccctacatctataaccctgctgcctcagttgatagggaagcagaaagagccgcttttttaatgtttaattttattaagtttgcagtttcccagtgcccaaactcatgttgatttcaaaaactgtccttttaaagcatgtgggcagggtgacaattcatagcaggtgacaaaaatgttttataaataatatccatggaaatggaagctgtcattgtctgcagaatgcagccaaaatattcagaagatttgtatcactctaagttctcgtgctagtaagaaataaaaaagcaaatgatgactgggcctctaagaaataaagtaaaattaggaagcaggagtatgaaaataatgacattgtgcagaaataaatacaaaaggaaagtagcagagaagc

SEQ ID NO: 48739 - DNA, 503 bp, Homo sapiens
  misc_feature (501)..(502): n is a, c, g, or t
ggtgtgtgtgaactcaaggctgggcatgaagataatattccttcagaggcagtgttcatagtcggaactccaccaatgcatggatacctccaaaaatttataccagaagaaggcagcttgggtgcagatgaaaagtccctttgactttcacacaaccggatgtggaggatggcaatatcctttatgtgcagacatcccccaaccaagaacaggactgtttttccctggatgtgatgaatggtttccaagttgtgagcagagtcgaaatcttggtggacaccacgcctaagtggatttttctgcaggtacagaatttcacagttcaagaaggtggctccagagaacttctagaagactacctcaaaattccaagtaaatattttgagggatttgactgtgaatttgttctacttattaaaccactgaaacacagttatgttaaaagttctaattttccaagaggaaagctaataaaatttattgggaaacaggtaaaaaaanna

SEQ ID NO: 48740 - DNA, 1039 bp, Homo sapiens
aactggagaaacagaaacctttacataatggacttcatctgttgagaaatgtatggatataatatttggttcatgacacactttcatcactggtccatgcttaggcttttatttaacttttgtatttatgtattcatatttaatattcaaaaaactgccatgaaccaaccacctaacacaactgactaatgtagtagctttaaaatttgactgccccactggatatcagacttgcatgggccagtagccacatgtgactatttaaatttaaattaataaaaattaagtaatattaaaaattcagttactcatgaacgccagccacatttcaaggactcaataatcacatgggactagtagctaccatactgtacaggaacagattacaggaacatttccatcactgcagaaagttctactgcggacgggtatggtggcttgcacctgtaaccagctgtttgggagccaaggccggtgaactgcttgagcctaggagttcaagaccagcctgggcaacatggagaaaccctgtctccacaaaaaatacaaaaattagctgggtatggtggtgcacacctgtagtcctaggctactcagggaggctgaggtgggaggatcacctgagcacaggggaggtctagcctgggcaacagagtgagacctgtctcaaggcaaaaaaaaaaaaaaagaaagaaagttcccattgggcaatacctagaaaatacctccttaggttatattcctagaactttttcctaatgaaccctaattggattaatcatgatctctgccttcatgaaacatcatcattggtttatgctgacactcttttatttgatttgatcatttctaaagaagttgcaatgagcaatcataaatccaatctgttactccactaatagaacactgacgtcatctttcatctctttgtgtgctccttggtcagagtaaatagcccagatttctatttatgggcaaacgtgtaaataaactatgttcatgtacaaaatgaaatacaaaacagctggtaaaggaagtg

SEQ ID NO: 48741 - DNA, 604 bp, Homo sapiens
ctatcagtctatttctacaccatggctatgagaaaaccaagaactgatcagagtggagttaatagtaatagaaagttccagggtagagtggtgagagtgcttatgacctataatgatagcatcatctccatcttcatctctctccctggtggacacacacaggcacgtgtgtccacacatgggtagacatttttatccctaactgtggtaagattgggcctatgataaagctgagtacagagacttaacgtcctatcctcaaaccaaaaagagtgaggagtgggagcacacaagcacattttcatatctaaataagaaaagtccaagttgagtctataaatgttataaacgggtaaggaaggtagagagtttatggatttagataatgtggaaactagaaggaatgggcacttctttctcaagcctgggaagactgtttgaagtaggattcttcaagttagttgccattgtgatttcctgtacaaaattattcatcacttaactgctgatgcttttctcttgaatgactggtcaggtttttaatgtaactttgagactagagcaaatctgacttgttctgcttgcttcctttccattcatttta

SEQ ID NO: 48742 - DNA, 258 bp, Homo sapiens
agagggagttgagtaagttggtctgtattgatgattacagttctaaaagttgattctgtggaaccggactgggaccactggagaatgcaggtctacagggcacacacaatgttcaatgagtgcctacccataacaggggtgtgagcagccttatttttgcttcacctttttaaactgattgttggatgatagtgctgctggtaaattttgcaacccatattccactgcttttcagacagttatttaaaaataaaataa

SEQ ID NO: 48743 - DNA, 338 bp, Homo sapiens
ataatgaacttccatgaatatatttacatatgttttaaccaccccccacctcataacagaaaaattcaggcaactaaactctagcaaaatggattgtttggcaccatgaagatcaatcacattatctataaggttggtgcaaaagtaattgcagtttttgcaattagaagtaatgacaaaaaaatgcaattacttttgtttcaaacctgatatcacccttcacaattttaaaattatctctttaattctgtgagaacagaaacttatactcatttgcgttttcactcctttttggtgcttaaacattcaatttttttctctcattgcgatatcagctc

SEQ ID NO: 48744 - DNA, 774 bp, Homo sapiens
cagaagcaagatggagtcaattatgtccaatttatcttactgtcataatttttcaaaggcagtttcaaggttactattctcatgattcaacacatcctcaaggagtgagattcagtctgtgtaagtgtatcatgactttctataacacgccttgtcatgcactcttctaccctgctagaattggagtctggcctcagctggttcctaccagcagtactgccatcacctcatcctcatctgccccatctgttgttttggaaccacttgtgtcctctgaaatgcatatgttgaagtcctaaccacctgtgcctcagaatgggactatgtttggagaaagggttttaaagaggtacttaaagttaaatgagatcattactgtgaaccctgatccaaattgacttatgcccttataagaaaaggaaatttggccacttacactcacagaggaagaaatcatttgaagacacagagagaagagggccgaggagagaggtctcagagaaaccaacccaatgacatttcgtcttggatttccagcccccagaattactggaaaatacatttttcttgtttaggccacccaatctgtactactttgttatggcaaccctagcaaactaatgcagtcaccaacccagggtgaaaatgggacattcccaactctagctcttaggccaagcttatttgtaatagattcttgttttcaaaggatatagatattgagattctcaatgtatttgttaaaatacattgtttcttgttaaaagcaaaaga

SEQ ID NO: 48745 - DNA, 388 bp, Homo sapiens
gggccctctgtgtctttagaagcagcttccaagggcaggaagacttccagagtgcaggactgagcgtgctgctaatcttgttctggtcgagagactgatgagagaggtctcagagaaaccaacccaatgacatttcgtcttggatttccagcccccagaattactggaaaatacatttttcttgtttaggccacccaatctgtactactttgttatggcaaccctagcaaactaatgcagtcaccaacccagggtgaaaatgggacattcccaactctagctcttaggccaagcttatttgtaatagattcttgttttcaaaggatatagatattgagattctcaatgtatttgttaaaatacattgtttcttgttaaaagcaaaaga

SEQ ID NO: 48746 - DNA, 349 bp, Homo sapiens
agcaccatcattttcccagtgtgtgtctccaaacacttggaatggtgtttgctttttagtttatgccctggaccgaaagccccacgccaaatttgtatcatgattagggacagcagagaattgtgccctccactagggtagccacagatggccatggtgcacttgaaatgtggctagtgtgactgaaaaactgaattttaattttattttaattttaaaagtgatgtttggctacacacggtggctcgcacctgtaatcccagcactttgggaggctgaggctgacagatgcttgagcccaggagtttgagaccaccctgggcaacaaagaaaaaactcatctctacaa

SEQ ID NO: 48747 - DNA, 391 bp, Homo sapiens
aaccgagaaagtagtgatggattgcctgatttttaccataaatatgacctgaaaataccttttgtccttatagagcagagggtcattaaaatgatcccgttctgtgtgtcaaatacatgaggtatacccactgagtcacatatgtaaatgttatcagctagaacagaacatggcatgagatgaggaccatgagagaggaatgagtagagaagcagattttacttccaagtggagggaagaaggcttcttggaggaggcggcatttgagtagggtgttgaaggatggtatccggacagaagagaatgaggctttccttgtacaatagcagaggtacacagctgataaagtacatgtgcttttcaagcccaaatacctttcaaaaaagaccat

SEQ ID NO: 48748 - DNA, 1313 bp, Homo sapiens
ggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactatcccagtttacagcagaagaaatgaaggcagagagattgagtaacttgcataagatcatacagctgggagtcaaaccc

SEQ ID NO: 48749 - DNA, 1100 bp, Homo sapiens
acagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactatcccagtttacagcagaagaaatgaaggcagagagattgagtaacttgcataagatcatacagctgggagtcaaaccc

SEQ ID NO: 48750 - DNA, 1176 bp, Homo sapiens
atttgcaatataccatttttatgcatgtaaagttgtattctaacatatttactttttgctcatttgattaaatttattactgtgtatcccatcattaaggtaactaattttcagtaattaaactgttggtcttctgtttagccattattctcagttctgtgcaggagtgagctgaaacaaagttgtatagcccagagagtgagaagctgcatttcatgtctcccaacagtcagaaagggattatgtactgtttaaggaaggagtttggcgaatattttgaaacccttttgggaaagcatagaatattgaaaatccaaaattaaccaaatccgtgagtgtgcaagctcaaagctagagaccttaggaatatcttaggatgtgcaaaacaggaagaaaacaagaactgagcaggcagcactaagtaagtgtcatatagcctccccacccacccttccaaccctactcctaaaagagccataatttagtcccaagtatacttttctgatcttttcctgtgacatattatggtatcttcaaatggtactgggtttcctgaggcttgtgctgctgactgccaaccccatcctagagagcactgagcgacagatactgtaaacatcctacactctcagctgtggaaagtaagaaagctgggagaaggctgtttactctttctgccttggaagtcaactaaagagaaatggattttgaatatttctatgtcttagaattgatcctatcccgtgtttgtttctgaggtcaactgtaaaaggaaaaaaggtgaattgactaagtcatccaaagaaatgtaagataatctataatatcagttatatttgaactgtttcacttagtttaaaaagaaaaaaaagattaccaaatacccaagtgacaaaagttctggttaacttgtatgaggctacattttgtgggttgctgcagtctgatctgtaaaagcaacacattacctatacgttaagctaaacatttctcctttaacctgagagcattccacactgaagtctgcttttcttgaagcaaaaattctagtgtccttggacttgctattttatcagggatcaaaggcaccttggagccccatgctttaggaattgtaatggcaaacaataaggtctgctctttaaagctagaatatagttacacatttcaggaaaa

SEQ ID NO: 48751 - DNA, 373 bp, Homo sapiens
tccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgcccttgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcac

SEQ ID NO: 48752 - DNA, 1714 bp, Homo sapiens
actcgcagacgttactgccctcttgcgtgccccggccacccccgggcggcttgtagccggtgcgcggggtggctggggctacgtgcagagctgtcgcggagccggagcagcagcggtgaaggccctcggctcggccgagaccgccgtgcccactgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtggcatttttcaactccgctggagccagtgcccaggaggaacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagaaagtacatcagccagggggcagtgtcagagacgcagcactgggagaggaggacatcgtcaggctggcccaggaccaggaggagatgaaggcttttatcctagatcaccactggattgctgacagatagaggaggtgggaccctgactatcacccctaatctgcagtggatttggctctcggcactcccaggctgggagctggatacctgccctggcagcatggctcagactgcatgacagtcacagactcgcctctgctcctgtggtccagtggccggacaccccctgggatggctcaaaggagtcaggacttggaattggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctctttggctgcattcagcccctacttacctggggaccccggctggggcacaagagcaccaggggggtagggcccaaagggatcaggggaagcctctggcctggagggtatggggcacacttccccaagggcggacccagcaggaggaagcccaggagctgggtcctgccgcccaggagctgggccctgccacccaggccgggctagggacatggcagggcctgggcatcctggcgctggacttgggcgacctgggaggcacagggaggggagagatgggcggccccgccccagcgcagtgccggccacacccatgcaccgaagctcctccctgccacaccccaaggcggttgccggagcttaagccccgcccccagcagcgagaacatccca

SEQ ID NO: 48753 - DNA, 1257 bp, Homo sapiens
actcgcagacgttactgccctcttgcgtgccccggccacccccgggcggcttgtagccggtgcgcggggtggctggggctacgtgcagagctgtcgcggagccggagcagcagcggtgaaggccctcggctcggccgagaccgccgtgcccactgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatgccgaacatcccaggggacctggagagccgggaggccatggtggcatttttcaactccgctggagccagtgcccaggaggaacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagtgagcgagaggctagggcaccgctggggggagctgccaggccatccgaggggccccagcatctgagccatgtcctcctgcaggaaagtacatcagccagggggcagtgtcagagacgcagcactgggagaggaggacatcgtcaggctggcccaggaccaggaggagatgaaggtgaacctgcaggagctgcggggcaggtgttgcagcttgtgggcgaccacaaggaggggcatggcaaattttgaccattgcccagaaccctgctgatgagcccactctaggagccccagtagcccaggagcttgggtgtgctgacgagcagggtggcttttatcctagatcaccactggattgctgacagatagaggaggtgggaccctgactatcacccctaatctgcagtggatttggctctcggcactcccaggctgggagctggatacctgccctggcagcatggctcagactgcatgacaggtacggcgtgcccaggatgatgtgcccaggcctctggccgcctgagtccagccccccacacaaccccctccaagctcccagcccctacaccataaaccatgagctctgtgccctct

SEQ ID NO: 48754 - DNA, 1231 bp, Homo sapiens
actcgcagacgttactgccctcttgcgtgccccggccacccccgggcggcttgtagccggtgcgcggggtggctggggctacgtgcagagctgtcgcggagccggagcagcagcggtgaaggccctcggctcggccgagaccgccgtgcccactgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatgccgaacatcccaggggacctggagagccgggaggccatggtggcatttttcaactccgctggagccagtgcccaggaggaacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagaaagtacatcagccagggggcagtgtcagagacgcagcactgggagaggaggacatcgtcaggctggcccaggaccaggaggagatgaaggcttttatcctagatcaccactggattgctgacagatagaggaggtgggaccctgactatcacccctaatctgcagtggatttggctctcggcactcccaggctgggagctggatacctgccctggcagcatggctcagactgcatgacagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgcccttgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcac

SEQ ID NO: 48755 - DNA, 388 bp, Homo sapiens
aacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcaggtgagtaggtcctggcatgggccaacaaggggggcggtggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagtgagcgagaggctagggcaccgctggggggagctgccaggccatccgaggg

SEQ ID NO: 48756 - DNA, 1803 bp, Homo sapiens
actcgcagacgttactgccctcttgcgtgccccggccacccccgggcggcttgtagccggtgcgcggggtggctggggctacgtgcagagctgtcgcggagccggagcagcagcggtgaaggccctcggctcggccgagaccgccgtgcccactgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatgccgaacatcccaggggacctggagagccgggaggccatggtggcatttttcaactccgctggagccagtgcccaggaggaacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagaaagtacatcagccagggggcagtgtcagagacgcagcactgggagaggaggacatcgtcaggctggcccaggaccaggaggagatgaaggcttttatcctagatcaccactggattgctgacagatagaggaggtgggaccctgactatcacccctaatctgcagtggatttggctctcggcactcccaggctgggagctggatacctgccctggcagcatggctcagactgcatgacagtcacagactcgcctctgctcctgtggtccagtggccggacaccccctgggatggctcaaaggagtcaggacttggaattggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctctttggctgcattcagcccctacttacctggggaccccggctggggcacaagagcaccaggggggtagggcccaaagggatcaggggaagcctctggcctggagggtatggggcacacttccccaagggcggacccagcaggaggaagcccaggagctgggtcctgccgcccaggagctgggccctgccacccaggccgggctagggacatggcagggcctgggcatcctggcgctggacttgggcgacctgggaggcacagggaggggagagatgggcggccccgccccagcgcagtgccggccacacccatgcaccgaagctcctccctgccacaccccaaggcggttgccggagcttaagccccgcccccagcagcgagaacatccca

SEQ ID NO: 48757 - DNA, 2041 bp, Homo sapiens
actcgcagacgttactgccctcttgcgtgccccggccacccccgggcggcttgtagccggtgcgcggggtggctggggctacgtgcagagctgtcgcggagccggagcagcagcggtgaaggccctcggctcggccgagaccgccgtgcccactgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatgccgaacatcccaggggacctggagagccgggaggccatggtggcatttttcaactccgctggagccagtgcccaggaggaacaaagggtgtgctgccagcccctggctcacccagtggcctcgtcccagaagaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagtgagcgagaggctagggcaccgctggggggagctgccaggccatccgaggggccccagcatctgagccatgtcctcctgcaggaaagtacatcagccagggggcagtgtcagagacgcagcactgggagaggaggacatcgtcaggctggcccaggaccaggaggagatgaaggtgaacctgcaggagctgcggggcaggtgttgcagcttgtgggcgaccacaaggaggggcatggcaaattttgaccattgcccagaaccctgctgatgagcccactctaggagccccagtagcccaggagcttgggtgtgctgacgagcagggtggcttttatcctagatcaccactggattgctgacagatagaggaggtgggaccctgactatcacccctaatctgcagtggatttggctctcggcactcccaggctgggagctggatacctgccctggcagcatggctcagactgcatgacagtcacagactcgcctctgctcctgtggtccagtggccggacaccccctgggatggctcaaaggagtcaggacttggaattggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctctttggctgcattcagcccctacttacctggggaccccggctggggcacaagagcaccaggggggtagggcccaaagggatcaggggaagcctctggcctggagggtatggggcacacttccccaagggcggacccagcaggaggaagcccaggagctgggtcctgccgcccaggagctgggccctgccacccaggccgggctagggacatggcagggcctgggcatcctggcgctggacttgggcgacctgggaggcacagggaggggagagatgggcggccccgccccagcgcagtgccggccacacccatgcaccgaagctcctccctgccacaccccaaggcggttgccggagcttaagccccgcccccagcagcgagaacatccca

SEQ ID NO: 48758 - DNA, 445 bp, Homo sapiens
aaggcaggggatcacttgaggccacgaatttgggaccagcgtgggcaacacagcagaaccctgtctttacaaaaaaaaaaataaataatttttttcccctttttggtagagacagggttttactgtgttttttcggggggaagaaaaactgatgtctggaactggcagggaacctgaagagtttatgtggtttaccattgtgtctgtgccttggactctttttagcaagtaaaatctaattgagtttaattgaatgtgttcccaaataaaaggcagagattttcagattgggcagagaaagtaaaaccaacatcaaaaaattaatcttcagtcccagcttactcgggaggctaaggtgggaggatcacttgagcccagaagttcaaggttacagtgagctataattgcaccactgcactgtagcttgggtgacagagcaagaccc

SEQ ID NO: 48759 - DNA, 356 bp, Homo sapiens
aaaggatggtctttgttatatcgtcacctaaaatggcattctacaattttgatttcagacgaaattgactgtttatttggaacataatttcattctgaataacttactttgggtatgcatgcagtatttcctgatgtaaagttaaatgcctcatggaccaataaattatttgtgatgaagttttaaagtcagtatatcctctcctaaatatactcccagaaataattttcttattaataattactataatggaaatctaacaatatgaacccagaaaactgttataaaactgatttttgtaaatgttgaagtgtagttgtgtaatttttctttctacttccaattaacttgtataa

SEQ ID NO: 48760 - DNA, 356 bp, Homo sapiens
atattctttaaatttggactgaatacaacacttcacatacaaatgtgggagaagagggtaacaaatttcattaaaataatccagtcagttagtaaacaagcagataacaataacaagcccagttggtcaggggtggtagggggagagtgggctagtacccacattgttacaatatgttatctaaaatgtccaatttccagtaaattataagacatgcaaagaaacaggaaaatatggccaggtgtggaggctcacacctataatcccagcatttgggaggccaaggcgggcggatctcctggggttgggagttcacgaccagcctgaccaacatggagaaatcccgtctctactaa

SEQ ID NO: 48761 - DNA, 355 bp, Homo sapiens
  misc_feature (321)..(321): n is a, c, g, or t
atattctttaaatttggactgaatacaacacttcacatacaaatgtgggagaagagggtaacaaatttcattaaaataatccagtcagttagtaaacaagcagataacaataacaagcccagttggtcaggggtggtagggggagagtgggctagtacccacattgttacaatatgttatctaaaatgtccaatttccagtaaattataagacatgcaaagaaacaggaaaatatggccaggtgtggaggctcacacctataatcccagcatttagtagagacgggatttctccatgttggtcaggctggtcgtgaactcncaaccccaggagatccgcccgccttggcctccca

SEQ ID NO: 48762 - DNA, 314 bp, Homo sapiens
agttacctgggcgtggtggcgggcacctgtaatcccagctacttaggaggctcaagcaggagaatcgcttgaacccgggaggcggaggttgcagagagctgagagtcacgccattgcactccagcctgggcaacaagagtgaaactcagtctcaaaacaacaacaacaaaaaacattatcagtaaaggtaaatctataagggaaagatggacttgacaatataagaattaaaattttatataatgtgtctggttcatcagagattgttatcacaggtttggtgaaatcctttggaacatcaacgtgtaggtttg

SEQ ID NO: 48763 - DNA, 871 bp, Homo sapiens
tatcagctcgtaccttcccacagcaagactggcagtcggcactactcatttgcatagggtgaaccaatgggaaacctctagattgtatctaaaccccagaaaattctgtcaccaatgctcttgagccacttgctggagcttgctcccactctgtggactgtactttcctttaaaataaatctctgcttttggtggatcaagaggacaagagttcgaaaccagcctggccaacatggtgaaaccccatctctactaaaaatacaaaaactttagcctggtggcgggtgcctgtaatcccagctacttgggaggctgaggcaggagaatcgcttgaacccaggaggcggaggttgcagtgagttgagattgctccattgcactccagcctggatgacaagagcgagactccatctcaaaaaaaaaagaaaatcatatctttattttggacagccatgtcccaattaaaattgggagttctgttgctgaggaagaagggaaggatggatattgggagatgactagcagctcgtgccgctgagtagtcaagagttggcagtactgggattcagaaatatcagaagagccaaaagggtcattttatggagggaaggagtagatcagcggtgtcacatacaacttaaaggagaaggaggatgaataaagcaaaacatgagaatctcagtagagcgatgaggaaggaagccaaactgctggatagatgacctcagtagacagagcaggaatggatcacccattcgatgagtttgacagagaaaggagagaaacaggacagttgttagaagagggcaaaaggatcactcgagggatttttgcaagattgtaaacttgtgttttaagacatttcttactg

SEQ ID NO: 48764 - DNA, 594 bp, Homo sapiens
caaaatagtcaggaaagttatgaagtaacatcatataatactttatccccaacaatattaaatgtgattacaattttacagaatattcaaatcaaaatgttatataagacaaattattattcttgcttttacatctccttagaaggagaaacattcaattgttttaaaaatgttctatttatttttcagaaatgaggtgttgccttcttgcccaggctagtatgcagtggcacaatcatagctcactgcagccttgaattcttgggctcaagtgatcttcctgccccaagcctcccaagtagctgggaccacaggcacgtgccaccatgcctggctgatttttttttttttttaatgttttgtagagacaggatctcagtatgttgcgcaggctggtctttaattcctgggctcaagtgatcctcccatagatttgtctgtgttttctctaaataggttataaataccttgagggaggaatcacaaataactaaaagaaacttttgtagagactatcagagtattatttccttgtggacacagtaaatgtatgatgatgagaaatcataataaactacaacattttctccaacc

SEQ ID NO: 48765 - DNA, 453 bp, Homo sapiens
tttaagaactacctgaagaacttgttaaagcagtaggcctggggtaggaccgattaattttcattttttacagacccatagatgatgctgatgctgttggtttagaatcacacttggggaatcacttatctagacaagggcttctgatatttaatctgtacaaatccccctaatcttgttatattgaagatactgattccataggcctcaggtgggtgggagtatttgcatttcaaacaagctcaaaggtgatgcttatgctactctccgcagacccattgtgggaagcaaggatttagatgatccactattataagcccaagtcatattgcatggtttggtgatttcagaaaataataggttcaaataaggcttcgagtttatttcctgaccaaataagattgtatccttaccaacaagatcgctgtttcttgtgtacagtatgaatatata

SEQ ID NO: 48766 - DNA, 419 bp, Homo sapiens
aaggatactggagctgggctgatccaggacagcttcctggaggaggcgggatttaaactggtcaatgaggctccacgaaacccttctgggtgtgaggtacagagctcagcacgctgctggtccttaaaaaaagaaccacatgagggcaataatcacgagaggactgtggtgctatgtgaagaagaaatgaaactcatccatgataatggagacgaaaatcctagttcttaggacggcctcaaactttagaaaacctcacacggactcagggagaagagaggggctaggtgggtgtgcagagtcccccagtggcttgttttcattggaataataacatcttacatttcgatgtggtaatgtcgctgttaaaacgcacttctcattgttagaaataaaaatgactcaaagatgtgaaagct

SEQ ID NO: 48767 - DNA, 744 bp, Homo sapiens
atttttacgttcatcatatgattacatatttatttgcacattcctttttttatttgcaaattatggaagagacatgcttatcacaaaaatacagatacagaaatgtgactgaaaagggaaatcccccacaactttctcagtcccatatagagctttggtttttgcataaagcatgtatagctttaaccctatttataacgtggttttcacttcaccttgaagacctttgcaagtattaatctcatttagagattatccatagtgtaacttaccataatttatttaactgttttcctatgggtatacatttaggatttcctgttttcctatattccatataatgagctatgaaagagtgtgagaggtggggagggtggaaaaatttgtgaacgtatggaagtatttctgcaggttggattcctagatgtggaatgactgagcagggtgtgagcatttacagttaaagataaaccaggccaggcatggtggctcacacctgtaatcccagcactttgggaggctgaggcaggagaatctcttgagcccaggagttcgagaccagcctgggcaaggtagcaaaaccttgtctctacacaaaatagaaaaattagctggacatagtggcatgtgcctgtaatctcagctactcaggaggctgaagtgggaggatcgcttgagcccaggaggtagaggctgcagtgagccgagatcacatgactgcactccagcctgggtgacagagca

SEQ ID NO: 48768 - DNA, 344 bp, Homo sapiens
ttttgtagggacgaggtcttgctatgttgcccaggctggtctcaaacacctggcttcaagcgatcctcagcttcccaaactgcttggattatagacataagccactgcacccagcctgtatttacattatacggctaatacatgaatacattttcactgtaaacaaatcaatcaatagaggaacacacagagcacaatttaaaagccccccttctttcttcaccatttttgtttgtttgtttttgagacacagtcttgctttgttgcccaggctgtagtgtagtggcataaacacagcttactacagcctcgacctcttggactcaagtgatcctcccacgtag

SEQ ID NO: 48769 - DNA, 434 bp, Homo sapiens
aagaataatttttaaatacaggaacatatcataaagtaaccatcatttacatgtgatttcccttttctgtatctcctaaatttaacacaatgaatgggtgttacttttataatcagggaaagtatcctcagagttttttgcttgttttaataataagatcaaataaaatactatgattgtcagccaatcacactgtctcttccttttagtttgacaagctgaccaatgtatttcgtaggactgccatttctcacacaacagaggaacataggtggagctacagaaaatacgaaaattaggaagacttaagaggagggaaagaactgataacacaagcagcaaattgcagaagttggcagaaattggaaaaagaaacagaagcagtgagtagcaaacaagacttctgttaaggaaaccaccctgagcagtcaccc

SEQ ID NO: 48770 - DNA, 204 bp, Homo sapiens
tttatggttttgaggacatgcatttaattttaaattttacaatttagattcagcatgaattgcaataaatggatcttcagcagagttactaatagaaaaatgagctttgccatcatcagaaacgtaaattttaatgcctgtgcaattgccattaattttatctccagaaatgacatcacagtatgtgccagcaggaagaccagt

SEQ ID NO: 48771 - DNA, 454 bp, Homo sapiens
actggggtggggaataaatgtcctgatacatgaattcggcacttctcaaactttaatgtgctcacaaatcacctagggatcttgttaaaatgtagattctaattcagtgagtccagggtgggcctgagattctgaatttctagcaagctctcaagtgatgctgctactgctgtccagggaccaaacatacttaggcaatcctcttctcttttagaatggtacaatcttatttaattacagagtacaagtttcaaaaatgagacattgaaactaaataaaatattctgcaacccctaagaaggaagtcagggcacaaaccagccaagcagggcaggatgatgagttgtttttccctatttggcatccatacagggcctgcacgctgtgatgaacttcccaaacacattgcttctctcatatttatctttccactcatgccagatgacagcataga

SEQ ID NO: 48772 - DNA, 522 bp, Homo sapiens
  misc_feature (10)..(10): n is a, c, g, or t
  misc_feature (35)..(35): n is a, c, g, or t
  misc_feature (39)..(39): n is a, c, g, or t
tggatttttngtagagtcggggtttcactgtgttngccnggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggcaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaaaaaaaa

SEQ ID NO: 48773 - DNA, 548 bp, Homo sapiens
tagaaggtgtgagttcaccatgtacctggaacatggggagccagaggatctggtgagcagctctgtcagtcaccatcatataccttgtgcctggcagagtaggggaggagcaaatttttgatgaagatggtgtcagcctgagcatccttccagaacagctcttgctcgggccccagtgacctgcatgttactccatctggtagacacttttcagtcctcattttccttaaccttgcttctcacactgcactgtccttcttaatacatgtttcttggttcaagcacacatcgtttaactgacttccttcctacctcttgcgttactactgcttccctggctcctttgcaacttttccccttttctacctggcctcgcattttggagattctcagggcgtggacctctttcctcagcagatctcatccactgccttgccttgaacgatccccttcacctagaagacttgacttgctttggagctccacgttcacgtgttttgctgtctacttgacatcttctcaagaatacctcaacattatctccaatt

SEQ ID NO: 48774 - DNA, 465 bp, Homo sapiens
ggcccgtatcctaatttaggtccttggtattttactatgctagcagcgaaaggaagcaagggtatatgaaccagtggaaagagagatctgcttttacatagatttatttgtgtttctcttttaaaccatgtgatctagttatatcttggaccacccacattacttctccttcccccatgaagggaagtgagtggagggagaccatgtattctagaacatgtagccaaaccctcgcctttcatttgtttgttttaattatttgtgtgctatattattagattgtaaattcattgtggattcattgtgattttaacaaatgcttatgtttccttcagtaactgctacagtatcttgcagttgacaaaaagtggaatgaataagtgaatatttattaccatcacatgacagacagccaatggcagctcaacagcggcgcctttgcatataagaaaagtgcacatatat

SEQ ID NO: 48775 - DNA, 736 bp, Homo sapiens
gatgtcccctagagcagtcaatctaagacagagaaaggtggaaccctcaatgtattttataatctagctccagaagtcatacaccatcatttccacagtattctgttggtaatacaggcggtcatgatttaatatgtaaagaagctacacaaggctatgcataacaggagcatgggccttgggagccatttggaggctggctacctcatgtactatctttaaaatatggacaaattaaataaaagaaagtctggatgaaatattaatgtgagattggtatgaagcaaggaagtgtagttaattatttgtataatgcttggatccattctgaaaaaatgcagtatcacttctatggaaaataagcttatagatctcagtaatattcaaggatcttgttcttagttttttttgatttgtgtctattggctttgttgttagtgattcaatgagtgaaacaataaacaaaggtatgaatgaatgaataaaaaagaaatgctaggcctagaccaatgatgagtattctggggtgtctgaatcaatgattttgattaaaccctgtaactctgaggtccattataagaggagacctagttaatacctatatggtaaatgatattatagtggaagttagaattatttgggattttgttcttaggtggttgaagttcataggtgtggattgtattactagaaaagatttagtaaatgaaaaatgaaacaaatatgtaaataaagg

SEQ ID NO: 48776 - DNA, 413 bp, Homo sapiens
  misc_feature (400)..(400): n is a, c, g, or t
  misc_feature (407)..(407): n is a, c, g, or t
gatgtcccctagagcagtcaatctaagacagagaaaggtggaaccctcaatgtattttataatctagctccagaagtcatacaccatcatttccacagtattctgttggtaatacaggcggtcatgatttaatatgtaaagaagctacacaaggctatgcataacaggagcatgggccttgggagccatttggaggctggctacctcatgtactatctttaaaatatggacaaattaaataaaagaaagtctggatgaaatattaatgtgagattggtatgaagcaaggaagtgtagttaattatttgtataatgcttggatccattctgaatcagatacttttggtagctatagactagaattcaggtcttgtctagttttgttggcatgcttgtgagntcatggnacatcg

SEQ ID NO: 48777 - DNA, 660 bp, Homo sapiens
aagacagagtctttccctgtcgcccaggctggagtgcagtggtgtgatcttggatcactgcagtctctgcctcccaggttcaagtgattcttcggcctcaagtagctgagactacagcacgcaccaccaggaccggtctaatttttttttttttttagtagagacgaggtttcaccatgttggccaagctggtctcaaactcctgacctcaagtgatccacccgcctcggcctcccaaagtgctgggattacaggcatgagccaccgtgcctggcccaaaatactattttaacgtatcaacacattaatattaaaatgttttgagtatttacagtcttttaatttatattaaatctttgaaattcaatgtatatttcacattaccacacatctagatttagtttaactacatttcaagtgctcagtagccacacgtgcctagcttattggacagtgcatttccagaaaagaacaactatcacagtaaccagattcgacacattttctggggtctgagtatcttgattgacattcttaagtctgctgtttgctgcgtccgtacgagtcaggatagtatactggttagctgggacgtttggaccagtgtgcatgggttcaaatcctgcctccactgcttaacacctttgtgctgaagtttcc

SEQ ID NO: 48778 - DNA, 408 bp, Homo sapiens
aaatagctctgaaactaagaagcaattatagcaagatttcaggatacaggctaatatacaaaagttgatcatttttctatatactagcaatgagcaaatagaatttgaaattaaaaatacaataccatttacattagcaccccccaaaattaaatagttaggtacaaatctaacaaaatgtgatacaagagctatatgaaaaaatctataaaagtgtgatgaaaaacatcaaagaactaaataaatggagatcttcatatggtaagggtaagagcaaaataaaaattataaaaataaataaataaatggatattgcatgttcatggttaagaagacttaaaattgttaagatatcagttcttcaaaatttgatctatagattcaatatagtccctatcgaaataccag

SEQ ID NO: 48779 - DNA, 460 bp, Homo sapiens
acagttgtcctaacaggcagttttgttttgccctttacagacactttaatgctgaaatgttctgtgccagggactcaggtttcccattttctttctctgtttttgtttttttaggtagttatttatgtgactgtcctcctaaccaaatggaccaatctgggcataaaccattttctcattttctctgcttatagaaaggaatgctttatttcagcagtgcagataacatcttgaggtctcaggaggatgacaaattgaaacagtttctttcttgcctaacatttcttacccaagagtcaagtgacgatggtggagaacaaatctctcttctcctgacaatttgcacttattttcttaatagctctgctaaaattcagtgaatttcattttgcttagagcctacttagtccctgccaacaggcacaggaagctttcattcatcagcacagtagtcctactg

SEQ ID NO: 48780 - DNA, 418 bp, Homo sapiens
gggatccaatgggagagaagcagggagtaaaactacacagagagaagcaaatctctagctgaactttgtaacaatttgaacagagtgagaagccttctgtccagaacttggggaagggcgcgaatctggtgtgcagactccacaggcaggggaagaaccaagcccttttctttcacaggttggggtcagacagcctgcagtagattttcaagcctgtattgctctctgcctagaaacagtctggggggtgttgaggggacatggtgggagtgagaccggcccttgggtttgctgggagctgggtgaggcctgtgactgccagctttcccccacctgtctgacaacctgcatgactcagcagaggcagcgataatcctcctaggtacacaactccagtgacctgagaatctcaccccca

SEQ ID NO: 48781 - DNA, 672 bp, Homo sapiens
tgacaataactatttcactagcaagggtagacgtaagcagaatacaggtagcatattcaaactgctgtggaaaaacaacatcaaacctagacttctctccccaaactatcattccaagtcagaaaaactattcatatagggatgggctattagcaagagtatatgaataacgtactataacaagaaaaaatgaattgagaagaaagtagtggttttaagaaggaaaggagaacaaataaattagtgaaacataaggttaagtctatacatattattttctaattgcctattatgtcagactacatgtagttagaaaatacgatgaaagaaaaaaaaaaaaaaaaaaaacctgtgtgttgggcgcggcgcccgggggcccctgagagaaaagctttttaaaacccattgcgttgggggcgcgccgcggggccccggttgagtgtcaggtgtgacccggggctccatgagcgcggttctcccagaggagaaaccgcgggcccaggaacaacagagcggtgggatttctcccccccaaattaaaagaaaggcccggggggcagaaccgagggttctggaaaccaattcccggagggggcgctgcggagggacaataccgggcctcatatcaagcagggggtccccaagcggagcaccgaatattaaaattagcca

SEQ ID NO: 48782 - DNA, 606 bp, Homo sapiens
tgacaataactatttcactagcaagggtagacgtaagcagaatacaggtagcatattcaaactgctgtggaaaaacaacatcaaacctagacttctctccccaaactatcattccaagtcagaaaaactattcatatagggatgggctattagcaagagtatatgaataacgtactataacaagaaaaaatgaattgagaagaaagtagtggttttaagaaggaaaggagaacaaataaattagtgaaacataaggttaagtctatacatattattttctaattgcctattatgtcagactacatgtagttagaaaatacgatgaaagaaaaagccatattataattccaacaaaaagataaaataattaagaataactgcaacaagaaaatataagttctgcaacaataaaactatacaatgaaactaaagaggcacaaaaaaggaactttaaacagattaaaaaggcaggaccacgtttttggggttaggagggtttaaaattataaatatatcaattttcactgttaatctataaattcagtgtaatcccaataaaaatgccaacaggttttccccaatagcattgaaatgattttaaaattt

SEQ ID NO: 48783 - DNA, 559 bp, Homo sapiens
gactaaaagagtttccagaatagtggcagaatatataggtcaagcataacacattacaatcaagattcagaacatcaaagattcttttttaatcctaaaagaaaaagtttggaaaatctacaaaaagaagtgtgaatttgacaataactatttcactagcaagggtagacgtaagcagaatacaggtagcatattcaaactgctgtggaaaaacaacatcaaacctagacttctctccccaaactatcattcagagtcgagggcaaaataaatagattttctgacttggaacaagtaggaataatgtacttatagtattcatcttcatacagggatggactataagtgatttttaaaaaacttcctacttgttccaagtcagaaaaactattcatatagggatgggctattagcaagagtatatgaataacgtactataacaagaaaaaatgaattgagaagaaagtagtggttttaagaaggaaaggagaacaaataaattagtgaaacataaggttaagtctatacatattattttctaattgcctattatgtcaga

SEQ ID NO: 48784 - DNA, 772 bp, Homo sapiens
tttcaatgcagctcttagttcccctgtaataggagctgaatgatgacaatttggctttgtgtgcattgtatcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaatgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggaggttgcagtgagccaagatcacaccactgcactgcactccagcctgggcaacagagtgagacttcatctcaaaaaaaa

SEQ ID NO: 48785 - DNA, 416 bp, Homo sapiens
tatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccaagattcttgtattgactcttctgatctccc

SEQ ID NO: 48786 - DNA, 420 bp, Homo sapiens
accaaggaagacttcaagagaaattagaagaaaatattttgaacacagtggaagtgaacacacatcaaaatttatgggatgcagctaaagcagtactttcagggaaatttagatcatatttatgagaaaagaatggttttgatctagtcatcttaagaatgaaaagaacagagtatactcaaaagcaagctcaaggaaggttcaagtggaaatcaatgaaataaacacaagaaagataacagagaaacatcattgaaacaaaaagttggctctttcaaaagtttaacaaaacttgataaactttgagttagactgaccatgaaaaaaaagatacaaatttccagaatcaggcataaaagaggggacattaacatcctaaagaaattttaaatattacaaaggattttttttttttttttg

SEQ ID NO: 48787 - DNA, 328 bp, Homo sapiens
gaaagtatatccttataatggagctctagtctttgtgatcaacctactttatgaccaagtaccagattttaacctgtacagtaactaagccagttttcattggcactttctcaattttagatattttgtcacattgttcacatacagttcacagtaagttcagttctatttgtggttttgaaaatgcaaaccccatgcttttagctagcttgatacaatttacaaagaagggcgaggataagagaaggaaggaggaaagaaagtagagaagcagagaaagaggaaggaaaagatggcggaagaaaaggagagaaaaaagaagacaaag

SEQ ID NO: 48788 - DNA, 450 bp, Homo sapiens
tgaaagtcccacccagtgggggactcttgccgccttgagagaagcacagctgatgtacggaaagcaatattgtaaacataacaaataaatacaaatcaaaaccacaagagaccatgtgatgcccatggctgaaataaaaaagacagacaataacaagtgtcgacaaggagacagagcaattggaaccttcattcactgctgatggcaacataaaaggtgcagctgctttggaaaaggatctggctgctcctcaaaaagttaaacacagagctaccacatgacgtactattccactccactcctaggtgcattcccaggagaaatggaaacataggttcacacagaaacttgcagacaagtattcatagcagcaatattcgtcctagccaaaatgtagaaatagtccaagtgtgcatcagctgatgcatcgcaccaacaaacatggttcat

SEQ ID NO: 48789 - DNA, 350 bp, Homo sapiens
gagtggatcaaatttagcacatagcctgagtgaaattcttatacagtagtacttaagaaaagatgaaagcacgcttctccatgctagagtttcaacaaggtggattccaaatggggtaaattgctctgtcttgaaagcggaatcagacaagagtcatctccatttgtccaataagtatcgcagtatctggcataaaatgcatgcttaataaatgtttggggaatacattaatggttgaatgtcatgtcttatttgatagtcttaaagcatttctgaagtcaggagagtattcactgattagaacagtggctgacattatagaaaaacctgatggtatcttagaaaaaaaa

SEQ ID NO: 48790 - DNA, 397 bp, Homo sapiens
ttttatttacacctttttaataaactacaacaactctaacaactgtttcttttaaatttattttttaattcacaggaaaaatgatatgtatttacatgcacaacatgatgttttgaagtctatgtacattgtgaaatgactaacactagctaattaacatatgcattacctcaaataattactgtttttgtggtaagaacactttacatccactcttagtatttttatgactacctcatattattaactatactcaccatgttgtacagtagatctcctgaacttattccttctaactgaaattttgtttcttttggtcaacatctccccagcccaacatctaaacaccccaggccctgataaccgccattctatggaggcttctcaagaaattaga

SEQ ID NO: 48791 - DNA, 518 bp, Homo sapiens
accagggagccttccctgaccccccaggctgggttgcgggccgtcatccctcccagcatatagcacagaggtgtcattgccttctctccaggctgagctaccccatgacagagcttctgtgcagcccagccttagggccaccctaagtgctaggtccctgggatgaatgagtgcagttccacagggccctgtgaccttctccagtcctgttcccacctccttatccaggaccttggccttgagcactccaatggtttaaactgactctaggaactttctgaattgtttaaggaaaaataactataacatgtcaagtttattagtcttaacattttctcattttgtcttaataattgtgttatcatttgctgttagctttttcatggtattagaattgcattctttcatgctcacaaaagctttgttgtggctatactatttatagtgattgctttgaacatctattatgtctctaattactcgttcacattttaaggccttattaatttagttttaat

SEQ ID NO: 48792 - DNA, 293 bp, Homo sapiens
aaaaccaagagagtgtcgtaacagagccaaggaacgaggatgttcggggcagagagtgcagctaagagtgtcgaatgccacttaaaagtcaagtagaaaaagaaatggaagatatgtgttggatttattcacaagggatcattggtgacctcaccaagaatagcttcattggagtaatgaggtggaagctacatattaccgtagagggatgaagagatgatgaggtagagatggcaagtggagataactcaaaatgtttgtctgtggaagagaatatgaacaacttcaggcca

SEQ ID NO: 48793 - DNA, 292 bp, Homo sapiens
attttgtcaataaggaaatgaaggcttggagcaaagtgcttaaaatcctagttattaaatatttgcaccattaaccagactccaggtcttcctagtccagcatcatgtcacaatattagaaacgaccccaggaaagagctccaggtaggtgtcctcttctgaatactggcccctcacccgggcctctgcggtggtgctgatcacactgtgtggcatttccctgaagacaatatatgctccttgagatatttatctgattcatttttaaggggaaacaatcaatgcattaaat

SEQ ID NO: 48794 - DNA, 290 bp, Homo sapiens
ttgcagcctcattattttcatttcagcatattgagaacatcctgccattgtccccaaatgcatttctttcatatccttttaactggttgtttgttttccataagactgattcatattcaatccgattgttgaacattttgattatgtccagttttttgcagttataaacaaaacctcacctaatgaacatccttatgcttcaatctttgcccatgtccctaaaagacatatcctaagggtcaattctgggattgctaggacaaaggacatacatatttctagggcttttg

SEQ ID NO: 48795 - DNA, 413 bp, Homo sapiens
ttaaaataacaaaattcttatttacttgtttttgaaacaacatttttcaaaccagcaagtgttttgtgttctttgttttgagatttcttctgcctaaaatagcacattattgggccaaactatcttctgtatttaaatgatgtcctatcttatcaatttggcagagaggaatgggtttccacatgggccctaatatacaaatacatgaacacatacatatacatatagtacttattattttattctgattttttctttagctacatatagtagtctgtataaaattccatttataaaaacttccttttagatttatttaccatatctagagccatagagggaattaattcctttttattgaattaatgttttgatttttactttttgcttataggttcaacgtgcatatgttt

SEQ ID NO: 48796 - DNA, 792 bp, Homo sapiens
gagttagtgggtgcagcacaccaacatggcacatgtatacatatgtaacaaaactgcacgttgtgcacatgtaccctagaacttaaagtataaatatatatatacatataaaaaatggggacagacccgggctccagctggtggacaggctttgaattctgcaggttgtcgcccattgctggtcatgtcaggaaaatcacctgtggctctcctgagcacttccggacctcagtgtctaacagatgaacaaaatgatctttgtctttctcaagggtgtcggcctcctcttagatcactgagcatttggagaggagggttattaaattaatgcatgagataagaaaatgtttcaactaggaattctgcatctctggaattgtattaaaccaattaatactccccaatcaattactctgtaatttactcaagtatattaaaagtattgtggcagtgtgcaataccagatttttaaaaacagtgtgtgcctctgtgggcagagctgcctgtcgtagaagggccagggcagcatgcagcgggggtgagggcttctgtctccagggttcctgggttcaaatcacagttcctccatatcctccagcctgactttgggccagttctctatccttcgggaacctctgtttctcagccctgtggggttattgtgcggataatacagatataaaatacccagcatatagtaggtgctcatggaattatttgtgtatgtggctcattttacaaatctaaaatgtgtgttttggaaataaaaaaaagagggaagaagtaaaagtg

SEQ ID NO: 48797 - DNA, 1510 bp, Homo sapiens
ctattctcctgcctcagcctcctgagtagctgggattacaggtgcctgccaccgtgcccggctaatttatgtatttttgatagagacaggatttcaccagtttgccaggctggtctagaacccttgacatcaggtgatccgcctgcctcagcctcccaaagtgctgggattacaggcataagtcaccgcgcccggccggattcatcttttaatcacatcttttgctatataaaataacatttacaggttcaagggattaagataagaatctctttgggggagggccatcattcagaccactacacattggttccctaacctctacccaaatagatttgagctaattcagaaaagaaaatgttatttttaaagaaacagaggcaagtgaaaaaaggctcagaaacctgggttcttgtcctgcctctgccattatctaatggtgtaaccatgggtgagccatttgccctctttagtccttagtttctttatcttatagggaaggagttggataagtgatcgttaacaagccttctagacctaagactttatgaagtgattcctaagtcatcttggagtttgtgttttaagtcaataatttaaaatgtgaatcaaaacattacaaattacaacattttgggtgagggtagtcctgttcttgcctaggacttgaaggatggaagactgagctgttggctgactgtcaactccttggggtattaacacaggataactaacctgtatttgttagctgtgtgcttaaacctttctgaagaaaagattttctacaagggatgtaatagactagctggaacattttcactacatttttagtgagactatagactgtgtagcctgaattttctttccagtagtagtagttcatcaaaattaaacactgacagatttttttctacctgaaactaggtcatagagtaaaaattttcacttgcagtcttactcttcagactcactgaatgcctgttccatcctgtttcattgctaggaaggacactagataaagccatgagcttgagatggtgtacttgaaaggaccgtttcaagatcaggttttataacacactcattatttatttcttctgtggagaggagaaaccaaattggattcaagtatttttctgatagtaatctatgtttcttagaataaagcaagttcatatctgagccagagggcataattatgtcagaataaaatataattatgtcggaataaaatgccctgtactaaagaggtcaactaacaggctgggaaatcttaagttttgtttttaagacaaatccttgaactctctgtgcctcgtttctcatccctaaatctgtgcaactcacctcacagggagttgtggagggtaatatactgctaatttgttcagtgtttcacaacaataaattatgcctaagatctgataaaacatagcaaacctcatttatgtaagtagagacaagcatggataagacttacagataataaagaaaattcattaaaattttt

SEQ ID NO: 48798 - DNA, 365 bp, Homo sapiens
tagtcttgtagttactacagccgagtttgtcattcctccatcactacctccatctttgtgtggccctactaaaaataccacttctgccagcagccttctttcataatcaaatctggaatcatatttcccccttgcatgggagatacaatgagcatcctgccctttcccccaggcacatcatctccaggaacatagttaggtttccagctgtgagcagttgcctgaggacattcctcttgcacctggtaccagggcagctcacaagtgccagaagttttcattcctcaggagtagcctttaaccaatggaggaagcaaactggaagataaatacctgagtgtccttgcccctcaggctaacgaagg

SEQ ID NO: 48799 - DNA, 1466 bp, Homo sapiens
agccaccatgtccagctcctttttgaattttttgtggagatggggtctccctgtgtttcccaggctgttctctaactcctgggctcaagtgatcctcctgtcttggcctccgagaatgttggaattaaagaccaccacaccctgcctaaagctagttttaaattatagcgtgtgtgtttgtatatatatattttttagagatggggtcttgctcatttgcccaggctggagtactgtggtacaatcatagctcgctgcagcgttgaactcctgggctctagcaaatctctctcctcagtccactgagtagctgggactacaggcatgtaccaccatgcctggttatatatttttaatatttaaaaaaatgccagtgtcagaaaaataagaacaatatcttgtttttggaattagaaatgtaatacatgcacaggttaaaaatttaaatagtgcaaaagagtacatagtgaaaaatagcctccttccctccctagttacctgatccctgtctcccagagacactctttctagcttatttggggtagccactgacaaatattctttgcctatactattattcatatgtttatatttctctatgtctaacacattaacacacatatatacacatatgcatgagtgcacacatggaagcctaatgtactctgaattttcttacctaatggcttatcttgtagtttgttccacattcgcacatagaaatctactttattctttctcgtggctgtgtaaatattccattatatgtttatattattagattctttataatggatattttagtggtttatagtcttgctattacaaatgttggcacaaagttatgttttaatgtactatgtatatttatttacatatatatttacacaattatgtgatatatacttaaggagcatatagagtcttcagtaatctggttcacagttgatacattaaaaaaaaacactgtgtggggtgtggcgactcatacctgtaatcctagtactttggaaggccgagacaggaagattacttgagctcagaagtttgagtccagcctgggcaatgtagtgagactctgtttctactaaaaataaaaaaaattagctaggcttggtggtgcacctgtagtcccagctactcaggaggctgatgtgagaggattgcttgaacccaggagacctaggaggtagaggatgcagtgagccgtgatcatgccactgccctccagcaagaccctgtctccacaaaaaagaaaaaagaaactcactgtatttatataccattggttgaaaataagatacttgaaatattcattcatatctgccccggtaaaatttttctccccaatggctcacatatctagaaatagttacataaatcgcgtctttggtaacttaataagttcatatttgtaagtagcctagtagtcgctagaaagtttcatttgggtatgtaataaaatt

SEQ ID NO: 48800 - DNA, 552 bp, Homo sapiens
ttttttttttttaaagctagtggttatggaaacacctgtcacttaggcatttgctaaccaacaacaaagtacagggtctcagacagcctggccctctgcaaggacattcactccctgccagttggccgtcagaggtagagaggaccactcaggggccgcacacctggtggagcacgtgcactctcacagagggggaacaatctgcacggagggcatgggcatcaaggccatgtgtgaagctggagcaaagtgggaggtgtgactagctggagacacaactgcagaaatgatcctgaaccgggaaggactgggaaagggtggaggccgggtgtggtggctcacgcctgtaattccagcactttgggaggcccaggtgggaagactgcttaaatcccggacttcatgagaccctgtatctacaaaaaataatttttctttttttttttttgagacagtcttgctctgttgcccaggctgcagtgagctgtgacggtgccatagcccttcggcccaggtgacagagtgagacattgtcttaaattaaaaaaaaaa

SEQ ID NO: 48801 - DNA, 542 bp, Homo sapiens
ttttttttttttaaagctagtggttatggaaacacctgtcacttaggcatttgctaaccaacaacaaagtacagggtctcagacagcctggccctctgcaaggacattcactccctgccagttggccgtcagaggtagagaggaccactcaggggccgcacacctggtggagcacgtgcactctcacagagggggaacaatctgcacggagggcatgggcatcaaggccatgtgtgaagctggagcaaagtgggaggtgtgactagctggagacacaactgcagaaatgatcctgaaccgggaaggactgggaaagggtggaggccgggtgtggtggctcacgcctgtaattccagcactttgggaggcccaggtgggaagactgcttaaatcccggacttcatgagaccctgtatctacaaaaaataatttttctttttttttttttgagacagcctgggcaacagtgttaagactctgtctcaaatataaataaataaataaataaataaaaataaagcgagatgttgccctcaaaaaaa

SEQ ID NO: 48802 - DNA, 400 bp, Homo sapiens
taggaaacactatgtactcccaaccaataatagcaagtcttggttaaaaaacaattactaagtacaaaaatttgtatcatttaaaactttagacaaatgataaggaagataccttagggaagttccccccccccatgagtatttagtttaatttatatataactttaagtaatcaaaataccctaaattccaggtgaatagttttctaccttctatcattttacatcattgatattctcagaatatatgcacaccaaactaagacatttcaaagtatgtctgtgtgttttgatccagggcattaaaatgtgtgtaggaaatggaaacaggtacataaatatcactgctgaaggtaaaaatatagacatatttacagattaacacttaaccgtggtatata

SEQ ID NO: 48803 - DNA, 383 bp, Homo sapiens
gaaaatcactagcaaagcagaccccaaactgaaataatgtaaatgtccccgcctacaaataatataaaccaaatatcaaacatgcactgtcaccttaaaaaacaaagatattttaaagaaacgtgaatttagtcttgtcaaatacattatattttaatgtattcatcattggcaaatatattttcagttcctatgatgtgccaggcactgtagttacctaataagaaatggtgatgtgatagacacagttcctgccttcaaagcacttacagttgactaacataaacaaataattatatgagcaattgtaaatagttaattaatggccataaactatgtgttgcaatgggagtcaccatcatgatagctatcatggattttag

SEQ ID NO: 48804 - DNA, 474 bp, Homo sapiens
taattgctgaatgaatcaagttttttaaaggagagatgtatatattttacctaaaaaaaagtgtttgttcatatcaggcagaaatggaactttcctatgtcatacccataaaagtgccgacctgatgtctttaagattggcagcttatattgacaatccatgtatgtcagttgaaggtgtcatggtttaaaattgcttcgccagtaacttgatttcacttttatagggtggttcttttacttatttggttgctacactagtactttaaaaattgatggtcagttgttgaggaggaaataaaatatttgatggccacaccatcttaaaaatactttaaaaaaattggaggctgggctcgatggcgcatacttgtaatcccagcgctttgggggaacaaggcaggaggatggcttgaggccaggaatttgagaagagcctggcacaacttcgtgagacccctgtctctacgattaa

SEQ ID NO: 48805 - DNA, 395 bp, Homo sapiens
gcaggtgcagccagctcctataagcaggagagcggcaggtgcagcatataggccacatcctccctcccatcataacaaggcacttcagcctctgctgggttgcaggccaatccttcatggggtgtagccaattggaggcctctctagggcaccgtggggtgttgccaggttccttgggcttgataaaaatcctaattaaggaggctcttgagccgcttgttcgagctcactctcactctgtgaattgtcttcaataagtctgttttccctactcttcttctgttgttttgtcttcccttgtttcgttcttttgttacttcgtgcattttgttcaattctctgttcaacacgccaagaaccttaacaactctatcaggtaaaagtcccagctactc

SEQ ID NO: 48806 - DNA, 470 bp, Homo sapiens
tgcagcattttccagtcacatatcagggttatactgaactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctccatgtcaaatagggctcagggaagccagtcatttccttagcgagatgattactcctttgccttgaaacatttattgggcccaccatgtatggatcagtgtgtggtagtgagtcatactcccaaatcagtgattcccaagtcttggctttgggaaccagtatgc

SEQ ID NO: 48807 - DNA, 264 bp, Homo sapiens
ccctttcccacagcagcactccctgactcttgggacctggcccttcccacagtccatcactcctggctgccctccatcctcctccctgccccatgtgggggtgggggcccagggaccctgcccttctccctgcctgtgccgtctcctcagcccttctgcccatacactctgctgggggatttcttaccaacagctgcttttaatataaaagtaataaaagcctttattatagaaaagttataattacagatatacagaaaataa

SEQ ID NO: 48808 - DNA, 464 bp, Homo sapiens
tactactaaattcgcggcgctcgacgattaattgagaatcgcattacatattattgtcacgtctctttggtgtccacaaatctagagcagttcctcagtatttccttgattttcacagccttggtacttttgaagattacacatcaattattttttgggatgtccttcatgagtttctttgaggtttcctcatgattaaattcaggttatgcacctttgtcagggatatcacagagggcaggctctagtcttctcatcatctcttaccaggcagaacactacctagatttgtcctattactagtgattggcacattaaacatttgattaaggtgatatctgtcaggatccttcactgtaaagtttatcttttcccttttgtctttagtgagtatagtattgagatggaggagtgatgcctctcaggggcccgccagcccaacgccccatcccccacaagcatgg

SEQ ID NO: 48809 - DNA, 350 bp, Homo sapiens
ctctggaaggtttcaaactttcccacattttcctgtcttcttctgagtcctccaaactgttctaacctctgcctgttacccagtttcaaagttgctttcacattttggggtatcttttctgtagtgccccactctactggtactaatttactgaattagtccattttcacactgctgataaagacatacttgagactgggaagaaaaagagattttaatggaattacagttccacgtggtgggggaggcctcacaatcatggaagaaggctaggaggagcaacaggccaaaaaggcttgtgcagagaaactcccatttttaaaaccatcagatctcgtgagacttattca

SEQ ID NO: 48810 - DNA, 289 bp, Homo sapiens
aaatatagaataggacaaaagattcaagtattatttaaacattattcagtgtagatgatagtggactattatatattttatatatatagctatgctgacatcagtttgttttatttgctcttcttaaaaaaaaaaaaatttaaggccgggcatggtggctcatgcttttaattccagcactttgggaggctaaggcagaaggatcgcttgagcccaggagttcaagaccagcccaggcaacacagggagacccttgtctaaacagtaacaacaaaaattaaccagacat

SEQ ID NO: 48811 - DNA, 473 bp, Homo sapiens
aagctgtcacttcagtcagtataatgcttgccagaaaaaaataggttaggagatcttgataatagtttaatatgatctgtatttttaaaatactagaaggttacttaatataccacatttccaagtccaaacggtgatcagagaaccccaaaataaaattttggcactgaattcataggaatacaattattttaaagcattagaaggaaagagaactcatagtctgtgttactgtgctgggtgggcttaggtttggggcttgtttgtattttgttttaccaatttagattcctttccacacttgcctgctaccacaagtaaggattgaggttaaatgggttttcatcttttattgggattggtgaaccttttaggattggtaaactgctttctcttgggcaagccaaactatctctcactaattgtttcaatagtggcccctttgaccttcctcttttcctttatctcaaaca

SEQ ID NO: 48812 - DNA, 660 bp, Homo sapiens
gaagaggtcgtctaatccacgtggctcacaaagccaattatgccattatttgtttgcactttataaggatgcatttaccaagtgggttaggagacctgtgggaaattcactgaatttcttatattaatctgtcagtgtaaatcatgggggagtgatttcgactttaaagcaagtacttcttgtatgctctgtattagagagcttagagagctgtggactgatctgagtctcaaacccgaattaatcttattctctgcacacctgcactcacacacacatccacacctaaaaaaatccccattccaaatacacaaaacgtatttgaaaaatgactagaagtaataattaccatgtgtctcagaaggtttgtatgactagattcatatgccagctttattctcgtcctgtgtttggatattgtcgtctgacagggaaggaagctggtcttcagattgttgactgttagccccacacctaggtgagagaaaagcaggggctcagcgaagaccctgagggagctgagaatcagccctggtgaaagtgtgagggtctgtcttttagttaaacacagggtgaagcagttatatactttaaatgtatgttacaattctacaattgcaagaatgacaagaataatattgcaaactgtggtcactagca

SEQ ID NO: 48813 - DNA, 486 bp, Homo sapiens
agaaacctctaaaggtgaagtaaactaggcagactggcaaggaaacttaagtctcaagggatgacctggcagggagttcccagaggctttcgtagtgttcacgtatttcaacctgggcactagaggaaggcacaatctgaaatgaccaacaagcacagacaacaaaagtcctaaggaaaatgctttctctagtcaaaggacctagaagaggacagtaatgaaggatggcctttttttttttttttttttttgagatggagtcttgctctgtctcccaggctgcagtgcaatggtgcgatctcggctcactgcaacctccgaggatgacccttttgacaatacttgctctactccaggtgaacaccatcaaagaaaccacagccctcctctccccaacaggctctgcagagactggtgtggagttcggtgaaccatccctgctgtgcacgaatgtgggggcaacactccccttcctcaccagtgatt

SEQ ID NO: 48814 - DNA, 1564 bp, Homo sapiens
gccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaaaaaaatt

SEQ ID NO: 48815 - DNA, 474 bp, Homo sapiens
actaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaa

SEQ ID NO: 48816 - DNA, 1412 bp, Homo sapiens
gccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtgatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaaaaaaatt

SEQ ID NO: 48817 - DNA, 2464 bp, Homo sapiens
  misc_feature (1339)..(1339): n is a, c, g, or t
  misc_feature (1879)..(1879): n is a, c, g, or t
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtgaatgggcttggcgggtttgcccactgtcggtggaacctcggccgcttctggcgccatttggctgccccggaggcgtttgcctcttaggtttgagcatcggtgaggttggagtggggctctttgcaatgcagagaacacgttctctgccgatatntgatctgtgagtcaggacctgtatttccccagagtcaaattgtcaggacctgtgagtcaggatctgagagtcaggacctgtttccccagagtctaattgttttgggaagcgaggtgtccattacagattaattttgttgtgcaggtcctataatcagtaatgttaattcttaagagaattttggtcacctacaagcgtgttaaactcattttttggaatgagaatttaaagaaggatagcctcaagaagtaagtgtgttgaaataaaaagggagaaggtggggaagaactaaatggaagcaggcattaactcttctggatttattcattccttgtcataacaccagcatcctattccacaattgaggaggtacccacaactgctccctgagttgtcagggaggttgaatattcagagctgtcctattttaagctttggtcctaaattgacttgaattctaaagaacagtttgaaatttagtgactgatatttctattttgtgataggattcaaaagagaaatgataattacacacttttngctcagttagttcaggacttgagtggatttcttccttgcactatctagtacctgtgtccttaagggcagggacctagctatctatacctggcttctagaactttgtgtgttcttaaaaataacaaaaacttgttaaatgacatagaattttcattgtgcaactttctagccagtgttactcctctggaatattaggattttcgtatattcagaatctaaagtatacgtaaagtgcacggtactagttccaaagtggttcactaaattgtacatgtttgtcaggataaaaaacatattattattttggccgggcgcggtggctcacgcctgcaatctcaatactttgggaggctgaggtgggtggatcacctgaggtcaggagttcgagaccagcctggccaagatggtgaaaccccgtctctgctaaaaatacaaaaaataagccgggcatggtggcacatgcctgtagttcctactctggaggctgaggcaccagaatcacttgaaccaggaggtggaggttgcagtgagctgagatggtgcccgctgcactccagactgggcagcagagtgaaactgtgtctc

SEQ ID NO: 48818 - DNA, 541 bp, Homo sapiens
catttactctgtgtgagctcagcagaattgaattccaacttggatataggtgtccatggtgttctacttaccctgggttccaccttcttccttgcctggtggcctttcatgacatcataattttgatcttcctttgttggatactctgatcttgttcacagagaaacataagcctaaatatatggtggttattttttgtgttgtggcagactctaaatactgagtctactcagcgttattttgcaactagagtggaggaatcctaaagtgttaaaagggctttgaagattgagtcagcatccttatcatacagtgcagaagtctgaaattacagagattatgcagtgtatcgtggtcaaccagtaaatttgttgtccgtaaagtacggtgcagaaatctgagattacagagattatgcagtgtatcatggtcaaccagtacattttttgtcgttaacatccagagccactgacagggagggtgaaaggcacagagtgaatttttttgttccttgggcttttatcaagttttgaagggatag

SEQ ID NO: 48819 - DNA, 2906 bp, Homo sapiens
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacagggtaaatacaaggagctgaaaaaatgaagagagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaaaaaaaaaaaaaaaaaaaaaaaaaaaaaaaaaaaaaaaaaaaaaaaaaaaaaaaagaaacaacacacaaaaacataaaacacaaacaaacaaaaaacaaaacaaaaaaaaaacacaaaaaaaaaaaacaaaaaccacacacaaataacaaaagaaacacaacaactgcttttcttactctttatactcttctcaacacagtatgacatctccatctattacattataatactcttctctaatatagttaactattccaccagccaaaaaaaacttatctcaactacttcaatcacacaaacaacacacaccaaaactctttttatcactactactctaatctcgtgtaactcaacttatcgctaatatcacatataaaaatcaatac

SEQ ID NO: 48820 - DNA, 2562 bp, Homo sapiens
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagttccaggtttgaccataagcacctctcacttaggtggaccagtcagctgctgtcgtcccagggtggagcccactgctacttcaggaggggcctgctcaggtgtagttaccacaggtgatggctgagttcagaaacaacccaggggaagtggaaggaagaaaggcaaaaagcatgaagggacagacaactgggaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48821 - DNA, 898 bp, Homo sapiens
catttactctgtgtgagctcagcagaattgaattccaacttggatataggtgtccatggtgttctacttaccctgggttccaccttcttccttgcctggtggcctttcatgacatcataattttgatcttcctttgttggatactctgatcttgttcacagagaaacataagcctaaatatatggtggttattttttgtgttgtggcagactctaaatactgagtctactcagcgttattttgcaactagagtggaggaatcctaaagtgttaaaagggctttgaagattgagtcagcatccttatcatacagtgcagaagtctgaaattacagagattatgcagtgtatcgtggtcaaccagtaaatttgttgtccgtaaaggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48822 - DNA, 656 bp, Homo sapiens
tgatgacttagtctttctaacccctatatatattttctcggtaatgtgaaaggaaactcaagctaaaaatattttaataaatcattgtgtcaaacataaatgttataagatttaaaatactgttttttattttgttccagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48823 - DNA, 2577 bp, Homo sapiens
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48824 - DNA, 2607 bp, Homo sapiens
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacagggtaaatacaaggagctgaaaaaatgaagagagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48825 - DNA, 2772 bp, Homo sapiens
atctgcttccggcctgcgagctcggtgttccgctttttgtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagttccaggtttgaccataagcacctctcacttaggtggaccagtcagctgctgtcgtcccagggtggagcccactgctacttcaggaggggcctgctcaggtgtagttaccacaggtgatggctgagttcagaaacaacccaggggaagtggaaggaagaaaggcaaaaagcatgaagggacagacaactgggaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaaaaaaatgtgtgtgtgtt

SEQ ID NO: 48826 - DNA, 243 bp, Homo sapiens
gatttttaacaattaaattttcctgtattcttatttatcctgaggtgccattggtcttgttatttaacttacccattatttcttctgaaacaattgcattacagtaattgtagataaatataaccctggagtactatagatcactgaaatgttggttgctttaagcaaaaagaagtatcaaatcaagtcagtttctagattgctgttctcctgggcactgattcatcgttcagagctgtcaaa

SEQ ID NO: 48827 - DNA, 592 bp, Homo sapiens
agcgcatctctgactcccagtcctgaggcctttccagttcaccagaccacctcagccattagaagggtgtcagctggatttgtgtgcccaacgaggtgtgttgcttttatgtaaaagagaagcacataaggaagaaatcatgagtgttcaggatccctttccagtcccttaaagaggctgcttttgcagtagcgacatactacccagtgagctcagccatgcagtttttcctgcagggttagagtggatcacttccttcagttgatcaccatttgaagtagcaggggtttgagttcagaggccatgtacgaaaatgattttaaaaatacctggagcctcatttagcacatgcaagactgagactcagccaagggggctatctagagaaggacggaaccccctccctctgtactatttactctgagttcataaaaaaattagccaggcgtggtggcgcatgcctgtaatcctagctacttaggaggctgaggcaggagaattgcttgaacctgggaggcagaggttgcagtgagctgagattgtgccactgtactccagcctgggcaacagagtgagactccgtctcacaaaa

SEQ ID NO: 48828 - DNA, 578 bp, Homo sapiens
acaggcgcacacatgtgcaggcttatcactcacagtggccactgtaacccttctacaataatgacgatgctcacatgtgccttggattgacttgacttgggcgaagcactgtggaagcttgctgctgtgtgaggaaggaagaatgcaatatttcagtcctctcctgctgggtcatttctgaaggggatgcactcggatgatggcatccgactggccagcctgcttccttggacattggtactggaagagactctcaagacaagatcggtctacagagaaccttctgggtggaactccttgggaggccactttccatgctcagaccccaaccctgaatcttgcttggtggcgaatgagccctgggaagctctgagaaggaaggctctggggacagggccagaggcaatgaggaatgacaactaagccagtgacctcagcacctttgttaatgggtcctaacgaggccatgcccccgtaaacattggatatgttgtatctctctttaaagatgcttaaagcatttaaagtagtcaaatatatcacacttgcagttttcattaaatgctcaattgattcaa

SEQ ID NO: 48829 - DNA, 698 bp, Homo sapiens
tctggaagctggaagtccaaggtcaaggtgttgtcagggtgggttccttccgagggctctctccttggcttgcagacggtgtcctttttccttgtgtcctcacatgcccttctctctcttcacatgcatcccttgtgtcttttcctcctcttaaaaatagacaccagtcataatccattagagccctactttaatggcctcattttaagttaatcacctatttaaggccctatctccaaataaagtcacattctgaggtactgggggttggaacttcaacaagtgttttgagagatgagggaaacaactttgtccatgcctttatatgtggttacattggagtgtgtgtgtgcatgcatgtgtaccaattaatgtagaacatgattagaactgaaggaacattgaagaatgcctcattccaaactcccattgtagaggtgaagagatgacacccagcagtggtttggcgaccaagttgggcctgaaaccgatgcacttcccccatgcagctctccattaaggagtaaaggtgagaacataggttcagaacattctgctgaaatgaggaggacagggtagatcattaatctccattcgatgttcacagcagtacttcctaagctgttttctaaggaacgttagtcttgcaaactgttgattagtattttataagttttttctgcagtctcatgaggaag

SEQ ID NO: 48830 - DNA, 161 bp, Homo sapiens
cacccgcggtggccaggagatgcccaaaacttacacaggacactgagctggaagtgtttggtcttctccccaacagcgttggctgcaatgcaggagtagtggccagcactggacaggtttgcctggaggacctgcaggaggactccgtctggggagatgtg

SEQ ID NO: 48831 - DNA, 364 bp, Homo sapiens
gtggcttcacttatagaagaatgctgagtgccaaatagtaaatgctgagggagtgctagagttagtaaatcatcattttgcaaccctcctagcagagactggcttaggcaagaatcatcaatggatgatgaatctagggaaaatttttcacgaggagcagagcatttacttggtcttaaagtgttttcccacagattggtttataggtgcaaggggaaaaatagtaactacatagtggagaaaccagggaatgccctgactaggtgggtatatcaaaattaacatcaacaatgagggctgatggacatctgtgcctcccataaaaccctgagaaggatgcgtgattatttatgtagtagtctgg

SEQ ID NO: 48832 - DNA, 180 bp, Homo sapiens
tttttttaaaggaaagcaactttattagagaagtaaagaaacaaaaaaatggctactgcataggcagagcagccagggactaaatgttcacggctgtgtcatgtgttccacacttgtctctagagtagggctgtccgacagaattttctgtgatgatctgtatctgtgctgtctcagtta

SEQ ID NO: 48833 - DNA, 404 bp, Homo sapiens
aaccaaatagtacaatgcctactccataaagtgagatattttgactacttttctcagtaattgataaaacaaatagaatacagaaaattcaaacaacacaattaacagacaagaacaaatggagacatacagaacacttcacgtaactgaagaccatatacgtgttctttcagtgcacacagaacatttataatatttggcaatattctgagccctaaagcaaaactctacaaatttctaaagactgaaatcacaagagcacctaccagaatgcaattagccggaaattaacaagaaatacaaaaaatcctgaaaattccatgtggtagacagaataatggtcctccaaagatgtccacattctaattcccacaatctgggaatattgaacaagcttatgcagc

SEQ ID NO: 48834 - DNA, 423 bp, Homo sapiens
cacaggattaaacctttctttagaatcagcaggttggcgacacactttttgtagattctgtgagaggatattttggagcatactgaggcaaatagtgaaaatggaatatcccacaataaaaactacaaggaagctatctgtgaaactactttgtgatttgtggatgcagctcataaattaatactttcttttgattcagtaggttggaaacactttttttgtagaatctgcgaagtgacattttggaacgtgtggaggcctatagtgaaaacctgaatatcctgtgataaaaactagagagaatttatctgtgaaactgctttgtgacgtgtagattcagtccacagagttaaacctttttgtttgtttgtttcagcagtttggaaacactccttttgtatgtagaatcagcagagggacatt

SEQ ID NO: 48835 - DNA, 470 bp, Homo sapiens
tactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttgga

SEQ ID NO: 48836 - DNA, 398 bp, Homo sapiens
gatccatgctttgaaccacacagttaccctttggtgggaaagcatagaaggcagtggtgaggttttcccaggcggtgtaaactcacacagagggacaagaacctgggaaaggaaagggtatgcttgaggagtggggctgtaactgagtatcccagcctcaaaatgcatttggaaacttttttcctttcttgttttcagccttgaaacattctttgaaatgctctggtatccctttcccaccaggcgctcccgggcacagggctcgcttatctaactgtgtgcttgctaagaaattccagaggctcattttgaaacaaactgggcagagagaccaagctgtagaatcatcccgcttaggcggagttatgaaccgttagcccaccactaccaggcaggag

SEQ ID NO: 48837 - DNA, 394 bp, Homo sapiens
tctgccgcttgctgctggcccagggccattaggacggtggttacattgtcatgagagcctatgaggaaggcaagaactgtcttcaggttagacactgagagctggaagcgggtggggcttactactgcattagcaaagaccgccacggttttaatctgccgacacaacctcacttggtggttgacagaggagcaaggccctgagattgtctggaatgttaggatattttcaatccatgtgacccgcttgtttcccctaaacacgcttctccttttcttttctctgtaagtgaatatcatttattttactgagagcaacagattacccaaagatatagctcagcagcagtatatatgaaaggactgtggtctttgggcatttttgttatctgttt

SEQ ID NO: 48838 - DNA, 331 bp, Homo sapiens
caaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaa

SEQ ID NO: 48839 - DNA, 2683 bp, Homo sapiens
ggtaaggtcaaacaaggcaacaatttgcctttttgtttcagtttccatattgtaaacaaatgtacttttcacggtgtatgctgtgaaaattttttgtatatttatatgttttgttcgtgattttgctgtttaaaatggccctcagccaggtgtggtggcacacgcctgtagtcccaactacttgggaggatgaggtggatggcttgaggccaggagtttgagtctgcagtatgctactttggcacctgtgaatagccattacagtccagtttgggcaatatagcaagatccatctgtaaaaataagtaaataaaatggccctcaagtgtagtgctgaagtgctctctagtgttcttaagctcaagaaggccatgatatgacttatagggaaaatacgtgttagacacatttcattcatatgagttttaatactattggcagtgagttaaacgttaatgaatcaacaatatatactaaataaggtatctttaacagaaacactcataaaacaaagtaaatgtatcgattggttgacaaaaatattaccagaggctcacagaaacttaatcgtgtatttgccctagtagtaataatttggtatttgctaattcagtatttgccacactttatagaacacaactacctcaaatacaagaattgactataaatcaaaaacttttttttttaatggtttccagtggatagaggaataaaaacagggtggaggggacaggaatggatttttgacaaatttaactttggtatcatataaatgtataattataaataaatgaataagaagtaatctctaaaaatcaaaagcacagtgaagtaaatgaacctaactatatattaaataggtaaatttctagtgggatgtatatgaaggacaaaaagaattgtaaaattttcctaaactgtaatagtaattatattatttgtaataaaagtattattctgaaagtattaatgtatattacaggatgaaacaaataagtaactgttaatgtcattggaaaccaagattttcagcaaaagaaagataaaaatattaaattgtagggttttgcataacttatttaaaactaaatttgaattggaaatatctgtagcagtttatggtatatttgcaaacagaaaatctgttacagaaaatctgttacagaaaatgttttacctaccactgttttctgaaaagacctggaaaccctgtacaacccagaatcaatgagtacccttggcatctagggtatagtctctaggtttcatttcccactgaaagaattggggttccttggaaaaacgactagttacagttcttgggaaagaaatgaatgagaagtttggaatgtcttgtcattttggaaagcaaggaggcagtctaagactactgaggtcatggtaaagaaactcaagagccaacttacggaggtttctactggtcatagattgaacagctttgagcatcggtaataactgcagtggactgtgaatcacatcaaagatgtttaaatccatgagttcataatacctaaaaagaaatttttttttagtttacttgcaacttttggagtatattaggaaatcaaatcattatttttgaaactgataaataatggaaaacagtatcaagcatttattctacttgcaagtatacttcatggcaaccaaatggtgattgaggggaagtttgtgttcttatatgtattcaagctaattaatgagcaaggacaattggaattagaatatcactgttttggaatcccagatgaaatgatggatctaggcagttgtcaccactgacagaaaaccttacaaaaagactaacccttcattgtgtgccttctacaagatactgttaattaaaaagtcaaacctagatctcatcaagtctggatctgactaccagtttatagaaaatgcagggacagagaaacatgttaagacagcaccataaggatacaatcagcaaagtgtaaatgtgagagaaactacaggacaaatgaccttcaacagataaattgcaaacacaaagctggtggggaaaccaatagattaaaatatttaagagacttttcaactaattatggcaaaaggctttatttgaatcctgattcaaacaagttaattttaaaaatctttttagaaacttcaggaaatgtgtacgctggatattgtatgacagtgcggaattattcatttaggcatgaataatggtaccgtggttgtttttgaaacctatctgttaaagatactatgatttatggattaaatgataaaatgcctggaatttgcttcagaataattcatattgagtggatgggggttcaaatgaaacaagactggctctgattttggtaaatttgaagctgactgatggaatacttgtactattctgttttttaatatagctgaaatttttataagttataaaagaaatatgcaatctaggtgtagtggcttgtgcctgaatcctggttacatagaaggatcccctgagcctagtaattcaaggctgcagtgagctgcgatcacatcactgcattcccgcctgggcaacagaagtagactccatctctaaaaagaaggaaagaaaaaaaggaagaaatatacagtaattttaaactgggagatgaaatgctaatttctagaagtccatttggttttgaagggtctcatgtca

SEQ ID NO: 48840 - DNA, 489 bp, Homo sapiens
gttgacttcacacaaggtttcaccagcggcatttatccatggtgcttaagagcactaacaaattccaggcaacatcctggcatgcagccagcccactggcattcctgtctggcacactttgcaggactggtcatgtgagaaagacagctaacagcaacaattgctgggtgatgaatagccagaaggagggcagcttgaagcatgacagggacaaggaatgcaatcaggaaaggctgacctggaacttggagcgggggtaagttaggctgtgatggatggaaggcagcagctgcatgtacagcatgctggcaggcacagtctgagaaacactgcttaatttgaatcgaatgggcagcttaagaggcagagaggcaagcagtgaccaaagccacaaaccgaaacacaaacctttcattaatctttccaaccatactcacactcttggcaacacaacttttcaatgagttgaacataactcattgttgttcc

SEQ ID NO: 48841 - DNA, 369 bp, Homo sapiens
caaccacagtttctagtgtgtttaggtacagggacatggacaaaagtctggagtgggcaaggcttacctaaagcttgcctagttctttagcttccgttggaccctctagggggctagcatggaataggaaagaggcagaggacaaacccagggatcagggctcagatgtcttccgcagtctgtgatcctgtagtcacgaagacccttgccactgtggtctccacccagcattccagatatctgccgtcaattgtattgatgcccatttaccatcttggctagtccagtagcactacatcctaccaatttcctaatagtaaagatactgtattgctaccctaacagagttagaaaatgaagtattaataa

SEQ ID NO: 48842 - DNA, 404 bp, Homo sapiens
tagtaaaagaaacgttaccaagtactaacaactgataatattgtgtgccatttctaactggggacaccaagtcaccaaaacataacttgtagaaaggacacaatgagccaatgccaaagtcagttacagaactggataaacctaaaccatgttcccatctctaggtattgtgaatttcaataattgttttgttgtttcagtgaaaggaaaaaatccatttagcaattatcattgctaatacttggcaagtttaagaaaggcttagcaagtttaagaaaatctccttggtctgcagggtatggtctgatccacatttactggtgtttttctataggaaccagctaagtgtgtctgactagttctccagacatcaatcactgagatgagaaagcacagatatttgc

SEQ ID NO: 48843 - DNA, 254 bp, Homo sapiens
gtaatcttatttacaaatagtctatatctccgagtctgttctagattattaggaaaaggctcctcaaccatggcctgaggaataaggaagtatctgtgcccttcaagccatcaaaacccacctcattctaatatctcaaaagaagatcatcacccccttccctcaggggtctgttttctttctggagccttgaatcctatttcagttgtactgcaggtccagagacatcccaccccaaaacccgaaaaggtttt

SEQ ID NO: 48844 - DNA, 1285 bp, Homo sapiens
gagagcccggcttctgcgcacccctctccagatgcgaggtgctcacccgcccctcgccctgctcaccccgacgcctcggtccccacgctctgggcagcaagacacatagcgaagcccctgacccatttcttctcagttgcgaccccctgtgtgagacccctaaagaggccaaggatcacagtaggtgtttcatcaaaatggtcactgtgtcccccaggttaggctgctggtatctcaatatccccctgcagagagaccccgcacccccgaatcccataccccaggctgcaaagcacagatctaatgccttccttctctggccggatttggagggacattgaggggcatgggtggcgccccaggctcgcagggttcgtggtccggaaaaccgagcccagggaatctccagctccgttctgttcgcagaaccttcgggggttagtcacaggccctggcccgcgcgggatctggaggcagagatttctcgacgtttggggacttacagctcgtctgggagcgactggattcccaggcctccgcacgctgaggttccggggaagagcactgtcttcaccacttctcgacctgcgccccaacccatcaaatttccagcactcgtccccctaggtctcataaaaactcctggcagacccttccgggatcacgcgtggctcaactcgggggccgtagctacgatccccgcgcagacgccggaatccggggcccggtccccgcgcggggtgcggcgctcgcggggggggggggatggggtcggtccctctcgggaacggctgctgttgtttctttagatactgaatataatttctccctcctccaccccactcgctgttcttaacaattttatttattggtttactattgtcttgtgaacgtttcttgtctcctccttgccttttttcatcccctttctctcttcatttctctctttttccttaattctgttgcaaagtttccttttcttgcttaatcaaaattctccccgcttactttgttctttgcccacagcattcgttcttcttttctccttgcctgcctgtcttctttcccgctgttcttggccgtgggcagacccggctgatgtaaggactgcagcttttccctggcatactctgcgccttcagatgtggtctgcgtctgcctgggtctcttcccacctcaatctgagatccttgcccctcacaataaattcgtttttattcattctgatgtttgtctacagaagttactcgataaagatgttttgtttcatgaatcaaaaggcttc

SEQ ID NO: 48845 - DNA, 1136 bp, Homo sapiens
aggaagagggtaacagtattgttaactggccatgaattttaatccctgttgtgtgtcgccgaatagtttacaaactctttttgcactggggttttgtttctcccactccccgcacccccgaatcccataccccaggctgcaaagcacagatctaatgccttccttctctggccggatttggagggacattgaggggcatgggtggcgccccaggctcgcagggttcgtggtccggaaaaccgagcccagggaatctccagctccgttctgttcgcagaaccttcgggggttagtcacaggccctggcccgcgcgggatctggaggcagagatttctcgacgtttggggacttacagctcgtctgggagcgactggattcccaggcctccgcacgctgaggttccggggaagagcactgtcttcaccacttctcgacctgcgccccaacccatcaaatttccagcactcgtccccctaggtctcataaaaactcctggcagacccttccgggatcacgcgtggctcaactcgggggccgtagctacgatccccgcgcagacgccggaatccggggcccggtccccgcgcggggtgcggcgctcgcggggggggggggatggggtcggtccctctcgggaacggctgctgttgtttctttagatactgaatataatttctccctcctccaccccactcgctgttcttaacaattttatttattggtttactattgtcttgtgaacgtttcttgtctcctccttgccttttttcatcccctttctctcttcatttctctctttttccttaattctgttgcaaagtttccttttcttgcttaatcaaaattctccccgcttactttgttctttgcccacagcattcgttcttcttttctccttgcctgcctgtcttctttcccgctgttcttggccgtgggcagacccggctgatgtaaggactgcagcttttccctggcatactctgcgccttcagatgtggtctgcgtctgcctgggtctcttcccacctcaatctgagatccttgcccctcacaataaattcgtttttattcattctgatgtttgtctacagaagttactcgataaagatgttttgtttcatgaatcaaaaggcttc

SEQ ID NO: 48846 - DNA, 532 bp, Homo sapiens
ccatttggggggcagagtttccaggtctgcttttaatgcgttgtcaggttgcatatgacatgcctggatgacttgaccaaaagttattctcaacactgttcgatgtaatcttgccagatacatctacatagtcattttgttcttattcatatgagtcttcttgaacaacttaggaaactgctgtatattaatgatcatacttctatgtgcattcccttttaaaacagagtcatccaaagtagaggtaaaaaaggaaagaaatggtaagacataaataaagtatttggtgcatttaaaaaggctattgcatatattagaacttttcttatagtatataatctctaaaatactgttgcatcagaatgttgcataatgatgttttgtattcattttgaagcataaattactttctactcatagttatttattggtattcctcttcagtttggggagttttctctttttttcctgtggaatttgctgtcacctttattttttataaattcaggcccacaagtggtttctacaactt

SEQ ID NO: 48847 - DNA, 885 bp, Homo sapiens
ctgtagaaaaactatatatgaaattccagaacagccaaataatctatgatgggaaagaaaatcagaatggttttatggttgcctgtgcacagtggggattaactgggaaagggtatgaagggaactttctggttgatggaagtgttaataatcttcaaagaagttagggaggtattagcattttaaaaactcatagaattgagtatattttatatgtgtacattttactgtatgaaaattttagtattaaaaaatattaaaattaccagtagtgaaacagatttaaacctcctgatatgatggcactgagaaatatgcaccatcacctctgtaacattccttccagaaatgcattgcctggatctaatcataggagacctcagacaagcccaaattgaggattctacaaaagaattgcaaaataactggcctgtagtcttcaaaaatgttaaggccatgaaaaaaaaaaaagctccagattaaagaactagagatatgacaactaaaaacaacatgtaaacctagattaaataactactgggtgaggcaaaaccattttgcaaaaattttcttttgctaaaacatcagtgggacaatttgaataagtgttgtagattagataatagtatgtataagtgttaataattactctgattatgtaaaagatatccttttaaggaaatacatatttaagggtaagtggcatcaagtcctgcaacttgcacatggttcaggagaaagaatggggaagcaaatgtgaaatattaatacaggttgagcatctgcagtctaaaactttttgagtgtggatgtcatgccacaagtagaaaattccatacctgatctcatgcagcaggtcgcagtgaaaacttttgtttcctgcac

SEQ ID NO: 48848 - DNA, 743 bp, Homo sapiens
gacttttagactccattgccactgtgttataggaaactgaggctcagagaagtgaggtaacatgtccaagtcacaccgtaatttgctgagctaggcgtcatacagatttgatggattctggaaccatggtccaatcgccccatacctgctgcccagcaatcacattccggaaaacaagggtacaaggaagcacacatttgctgccccaacccgctctgcctcatgtgatactcagctaggtgctcttgctcttctccccattatattgtaaaacaattgagaaccaagtttataatattttaatcatctttgtatccacataactcttagctcagttgggtgcttagtagctcagttgggtgcttggtagctcagttaggtgcttggtagctcagttgggtgcttggtagctcaggtgtttggtagctcagttaggtgcttggtagctcagttgggtgcttggtagctcagttgggtgcttgatagctcagttgggtgcttcattaaaatgtccttatttcaacagaaaacatcttcctagcttccttcaagcaggaattttcctgctgtcaatgttcctgttcttaattgcaaggctctttctttcagccttggcctgagtaggtttagagaatgacagggaaaagggaagagggaggaaaacttcacatcgtggactgtgcaccttcccctagagtatagacaattctgcattttgaagagattgagtgtggtttcagatc

SEQ ID NO: 48849 - DNA, 480 bp, Homo sapiens
tttaagcacaaaaggttaaaaagattacttcagttttctgttagttcagtccattctgttaactcttgttctacttgatattcatgaacctttcagctcttcatgagtcctgtatgtttctctctattccagtgtcccaatctccaaagatatcagaaacctgcctttaagagcacctgtcaaagtactatatctgattataagccatcttttgaaaaggatcaaagctagacaacaattgtctgtgaatagcaaaatgtccagggtagttacctcaaaaacactatggacaaagaaatttgtttatttctgtagcaatatggtttggctgtgtccccacccaaattttaccttgaattgtaataatcccccttgtgtcgagggtgggccaggtggagataattgaatcatgggggcaattttccctatactgttctcatagtagtaagtctcacgagatctgatggttttataaatggg

SEQ ID NO: 48850 - DNA, 409 bp, Homo sapiens
ttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccctgggcaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaa

SEQ ID NO: 48851 - DNA, 725 bp, Homo sapiens
gaacatacaaaatttctgagtgcagtttaaaacattgagtgtaatttgtaagtttcccttaaaataattgtttaaaatttgcttacatagaatcagatttgtaagttgaactatattcttcagagaaaaacaggaatttgaattttaacttcaatacatcgaatactaatttttaaaatcaataagacaaaacaactcttgaatcttttctgtatacagaaatccctctcaagggtacaaaaaaaatcacactgacagaaaacatattttgctgtttgtaccttgacacggcttaactggtgggcaaaatggattcctgtgttctgcctggctactatgtagttgccgtagttatcctctaccaccccccaccccatcccatgccctgcagctggtgtagatacacaggtgtagagcatgctccctatttttaatcccagttacttccgataagagcaggactttgccctttccaccccactccccacctcaagcccctgatgaaggagtttcctttaggtctgtcttctccgaattcctttaggatttaaagtccataccttgcaatttagcacttaatgatatgccctctcttcacagtctctaatactttcaacatgtgtgagtcttgccttcccaagcagactaggaattcttttcttccttattcccacatctttgttccagccagccatctaacagacattaaaaaaaacaaaaaaaca

SEQ ID NO: 48852 - DNA, 1579 bp, Homo sapiens
  misc_feature (1)..(1): n is a, c, g, or t
  misc_feature (1397)..(1397): n is a, c, g, or t
ngccagggtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggtgggtgtggttgccatgactgctgctgctgacgctgatgggtctcgtgctgctattttggggaagccagaaataatcatgtgctaacaaacaggcagatcgacccgaaccatcatcattaggagggtgcatttgctgagtgggcgtgcgcagtggtgagagtcactgtgagtggagctcacagctggggcagacaccccgagcggcagggagttgaacatgaccctagagatgcacagtgtagcttaggctggttaaagtacattaaccaccaatacctatttgctgaataccaactgtgtgcccagaagtgtactgggtaaggcatgtgatcccagacacttctcatgccacttccacgatgaagtcactttctatgtactgactaatcctggtcttgcccctttacccactgctcaccacttgaaaatagattttgcatatctttttttccagatggtggcatcttcacacacaagaccctacttcccaagtggctgttctttctcacatatcagcctagacaacttacttacctcctactgagtaatcntatctgtgacataattttatcaaacaataacaatccaccagaaaggaggaaagggtacccatctgcctgccagcaagtcactattcataaacaacttatggcagacaagtttgaaaaaaagaaagatgctacagacagacctcaagcttatgacaggtagcaatttttatcaaaatgacttt

SEQ ID NO: 48853 - DNA, 491 bp, Homo sapiens
tgatgtgttcagaggatccctgagagaccgtgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgcaacacggtctctcagggtaccgagctcg

SEQ ID NO: 48854 - DNA, 1825 bp, Homo sapiens
  misc_feature (1)..(1): n is a, c, g, or t
ngccagggtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttc

SEQ ID NO: 48855 - DNA, 1738 bp, Homo sapiens
  misc_feature (1)..(1): n is a, c, g, or t
ngccagggtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagttgtattctttgcttaagagtcagttttgtacctactaagaaaaccccatctaccagtcctaaagagataaggcatttgatttggagagagaggaagcagtagaaatgaaataaactaaaatgcaaactgca

SEQ ID NO: 48856 - DNA, 912 bp, Homo sapiens
agaatagaatgaatagaatgagggctagagatgggagggttcctgatgagagagggtcaaaaagtgagttttagtgaaggactaggtctgaaatagttacgttattgaatttaaaaatttaacatttcaaatatgtctttctttgacaaaactttacagagacactgaagtccaggatcttttgtccagaatgtaaaatatttgtcaggaattgacaaaagaagctactgctcacaatgtactcttttaagaggagagtaagagtccctgtttctgtaaaggctgatagatgactgctggcaatacctgtactgcagtttcttcaggaacaggaaacagaagaaaacaatctagctgttttgtgggatatatttgaagtggaggggccccttctttaaccatttgatcctggtgacacattgctaaggcattttccatacctgtaggggatcctgacgcttttaagctcattggtggccccaggtcgatgactgcacatgggctccctccagtggcgaacttctcacattacagaatcatcactgttaaccatagtcatttcacaggacccgggatacagagggatctttgaaaaaatctagtatagttcttttgttttaaggacaaggaggctgaagcccagaaaaactgaatgacttaccccaaatcacattgataattcaaagacagagttttatgcttgcctcctggacaataattctcatgcatggatttcttttttatgttaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaac

SEQ ID NO: 48857 - DNA, 1789 bp, Homo sapiens
  misc_feature (1)..(1): n is a, c, g, or t
ngccagggtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgcaacacggtctctcagggtaccgagctcg

SEQ ID NO: 48858 - DNA, 1900 bp, Homo sapiens
  misc_feature (1)..(1): n is a, c, g, or t
ngccagggtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagggtgacatggtagatctgccacgccccagctgcgtgactttgggagttcctttgttttctcatctgcagaatgagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttc

SEQ ID NO: 48859 - DNA, 437 bp, Homo sapiens
cagatgcctcctttactcgggataccctccttcttgcctatcatcattcagttatgtattagatctttcctatcttttaaatttttctcccactaggcactgtgtcacgtgcctacagtcccagctaccccaggaggctgaggtgggaggatcatctgagccccaggagttggaggctactgggagctctgattgcaccactgtaccccagcctgggcaacagagtaagaccgtgtctaaaaaaaaaaaaaagaaaagaaaagaaaaaaagagaacgaaagaaagaaaaaagaaaaattaactattgactctgtacaggcatacttcagagatattgtgagttcacttccaggccactgcaataaagcaaatattgtaatttcccagtgcatagaaaagttatgtttacactacactatagtctactgagtgtgcaa

SEQ ID NO: 48860 - DNA, 589 bp, Homo sapiens
tacagttttgcatagacaaggtgaacatttctcaaaacaccatgtctctccaattttctaatggatccaggcatgtttgcttaaggtctggagctggatctgtcagacccctcaatggaggtgcaggctttgcaggcagcagtgcatgtggtggctctgttgctggaagtgaattttcctgtgccttgggagggggcttgggcagtgttcctggtgggagccatgctggtggtgcccttggaaatgctgcttgtattggctttgctggaagcgaagggggactcctctctggaaatgagaaggtgaccatgcaaaatcttaatgaccgcttggcatcctacctggataatgtgcgagctctggaggaggcaaatgctgaattagagagaaaaatcaagggttggtatgaaaaatacggacctggatcttgccgtggacttgatcatgactatagcagatatcacctaacaattgaggatcttaagaataagattatctcctccactactactaatgctaatgtcattctgcagattgataatgccagactggctgctgatgatttcaggctaaagtaagtgacagaaga

SEQ ID NO: 48861 - DNA, 1518 bp, Homo sapiens
  misc_feature (720)..(720): n is a, c, g, or t
  misc_feature (732)..(732): n is a, c, g, or t
  misc_feature (736)..(736): n is a, c, g, or t
  misc_feature (926)..(926): n is a, c, g, or t
  misc_feature (1036)..(1036): n is a, c, g, or t
cacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaaggctataggagaaatttctcccttctgaatgtgtccaactaactctgttcacctgagaaatcatattccccagctctgggtatccctgaataaccacaggagaacagttccaggccctgataagtcagctattgcaagggggacctggctggaagatatgaaggaaaaatatcattcttgaactaataagttgagagatcacagccttcaggggaccagaagggaaggctgaacagagaagggcaatttcacgttcgccatgtccatatttctatcgtcatgagccatctcaccttacaggcagggaagttttgagcttanagaatgggatgngtcnagaaaaccgtggctcccccagctctgttcctggattcagtgcctgttgtttcatcctgtgtagactggagtcagggtctacacagttggaattctatggaaccaagatgctgtgtggcagatggatgtggactccaactgtgacaatccagaaggccttggggacttgtttcatgaacagctccctgtangatctctgttggggtgggggattctaggggcatctccgcagttttcttctgaaaacaaaacgaatacaagttgggcaggtgcaacaactgtgcatgcagtcccctcccanggctggctagcagtattgttgggtaccgtaagcacttagcattgttaagtgagcataagtaacaagatgcaacagcctctggccaagttttgaagattttgttttaaagtatgcttttagatgttgacattcatgattattaaaaggaacaaaactcaatttggggtctcaagagccacaattctagacttctaggatgtcaggagccatgctcttaagcttctcaccctgctgttttaatgagattaatgattattttccactgagcacctacctgtgatgttcataaaaaagtgaaataaatgactcacatggagatttggaaggatatcactgtggaaagtagatgttaacagcctctagaaatatgataattatcagctatttgagatgcagtcactgtaatgtgataacaagatgtgttgtgcaggtagaaagcatggagagaaatggcacaaagtagagttataagaaaaaagaaa

SEQ ID NO: 48862 - DNA, 531 bp, Homo sapiens
aggagatgagaagttgagctaatgacttccagccttttccagttaatattgtccaggtaacccctgccttttttggctggctgaaatttgattttgattgagggttacagtttcaagtcatttagcacaaataagtcaaggcttttgtctttaaggccttgttatccaccaaatgaacactgtttgagtacgtactgtatgcagaccagttgctgtgagataatctatactactgttcctgtctcagtaaaattagatgggcaagtgttccaacttattaaataagtcatataggtaattattgtccaacacatgtttaagtaaagtatatgataattgatcatgtgtatgtggaaaagctgtacctgtttttgtttatttgttttaagatggagtctcgctctgtcacccaagctggagtgcagtggctcactgtaacctctgccttccaggttcaagcgattctcgtgtctcagccttctgagtagctgggattacaggcgcccactaccacgccgagcaattttgttt

SEQ ID NO: 48863 - DNA, 304 bp, Homo sapiens
ggcagaggttgcagtgagccgagatcatgccattgcactccagcctgggcgacacagtgagactccatctcaaaaaaaaaaaaattaaattaaattaaaagtaagagctaaaactataaaactcttagaggaaaacagagagataaatctttgtaaccttggatttggcaagggattcttagatatgaaaccaaaaggataagcaactaaatgtaatcaattggacttcatcaaaacaaaaacttttgtagttcaaaggacattagcaagaaagtgaaaagacaactcacagaatgggagataa

SEQ ID NO: 48864 - DNA, 426 bp, Homo sapiens
tcttggagaggggacactgaggcagaggctcagctaggaagcaagaggtgacaggaacaaacaggaggcaccactgctgctgtttccaaggacagtgtgctgcccatgaccccccgagcctggcccacgtgacccacatcacatcctcaccatcttctaggagaaatgagaggattttaaaaccagccttagctgagtacagtggctcatgcctgtaatcccagcactttagaagggagggcaggaggactggttgaggctaggagtttgagaccagcctgagcaacatagcaagacacccatctctaaaactaaacaaataaaagaaaataaaaattaaaaccagcctcttcaaagacacaattataggcactctgcctatggagtagccattctttatgcctttactttcttaataaacttgct

SEQ ID NO: 48865 - DNA, 216 bp, Homo sapiens
tgagatacagtctcactctgtcacccagtctgcaatgcagtggtacaatctcggctccgcctcctgggttcaagcaagtctcatgtctcagcctcctgagtagctggtattacaagtgtgcgccatcacatccggctaatttttatatttttagtagagatggggttttgccatgttggccaggctagtctctaactgctggcctcaagtgatctg

SEQ ID NO: 48866 - DNA, 400 bp, Homo sapiens
agaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagac

SEQ ID NO: 48867 - DNA, 336 bp, Homo sapiens
gggaatacactcagacttagggtttctcaaatttacctctatgtaactgactctagttttcatttccaaaaatctcttgatttcattacctacaacaatatctaaatccagcagacaaatgcaggcaagctagtaacatgtccccagcatcttctgtttcccatgcttcgctaaccatgattaacttggatatttaaaaggattacagagtaatcattatagaataaatttactaacaaattaactaacttataaatttactaatttgttaggatagttatagaataaactatatttattcagccagaatgtaatctcaaagaagacaaaactttt

SEQ ID NO: 48868 - DNA, 771 bp, Homo sapiens
gggactacatgtgcattccaccatgcctggctagtttatttttttcacagacgggatctcgctatgttgcccaacctggcctcaaactcctgggctcaagtgatcctctctcttggcctccagggtcactggggttacaggcacaagccactgcacctggctgtagttcttgagtcaagtatgacatatgctggtgaatagaaacaggtaaattggttctaaaactcaatctctggccagagctaaccagtgggcccacagggtggccaggtcctgtggccctggttgggacagaaggataaagcatcttcctggagtacggggaagggctcaaacctggcccatgttgggtcagattttggcctgcacagctggtgcccaggtaagctgcatgccaggagggcactggtacttctcccctcctgctctgcatcccccagcgctgctgccgcggtgctagtgacacatcactgcccactggaaagtttcatttcatgtcttggccatagcagctctagtgctttttcttcacctgcctagggtccattgctgatgacttttacacaggacagcaagcaggtggacatcagcttaggctcacggaggtcttttagagacctctggttcctctttgtagaatgagggatatactgggtcagcgagtctctcacttcattcgcctgagttccaccttggcaattttgtaatggatcatgtactttttatttatcttgaaatgacccaatttatataaaaatgttctgctttcaa

SEQ ID NO: 48869 - DNA, 724 bp, Homo sapiens
cggttttccaggtgctttgctttaataatgatatttcactgaattttcaaaacgatggttccctgtggtagtgggaattatgctatgtgttatatgaaacaaagtaagtttgatttttaaaggcatgtattctggcctgttggttgatagagttcattttgatttcttcttctaggggagaagttttatgaacacttaatggttttagagttctatttgtagaaaataaagataaaatccagatttctttcaggattattttcattttgggaagaaccaaaacattggattcttaatatctatagcataattaactttgcccaaatcttccattaaagaataattatgtatacaagagaacccacatgtaatatttttgttcctaaatttgtttagagtgctggttctcaaactttagcatgttatcagaatcacttggaagaagacttcttcaacacattgctgagtcccattcccagaggttcagaaaattagatgttgacattttcaaagtgaacttaagagaagtaagtggtctgcatttataggaaccatgtttttggcatttgaggtgatgccttaattgatgaaaacattgtgcaaagtataggagtgtttataaattagggaaccatatcaattaaactcttatctttttgcattctaaaatcatctatcttgcattattagcacttaggattggatttcagatatgtttaaaaaa

SEQ ID NO: 48870 - DNA, 428 bp, Homo sapiens
gcaaatgagtaaatgggtttatattgtagaagccaaggttttcactgaaaaaggatgaagatacaaatatggaatagagggaggcaagaaagaacctgcagggatgaatagggatatcactctgaactggtgatttccaatatatgtgtgtttgtggcaaattgatatacgcatgtgtgtatttatgcacatatatgtgcacatgttaaatgcatgtatttcattgttccatctactggaaaggttgagaatcaaagatactcctctaataagagcatacctaagcacctgtatctgagtttctaatgtcactgcccctctaaactgaaccatactcctggaatggctaatttcaggactggtgcaagatgatcctgaaacatcttatcagacaagatagtaaagaactgctgttaaaaaaaaaagaa

SEQ ID NO: 48871 - DNA, 425 bp, Homo sapiens
tataataggtgtccttttactttcaaaaattgtagcatttttaaactaattttcttaagaatgtgatacagaaagaaaactgaaaaacaacatatttatattttatctgattttataagatttttttttcagtcaactggtgaaattggtaaatcctgccaataagtctttataccaaattacgttttaaaattagtttcataaaaggaacaaaagcatttccatgctagacaagatgtcacttatcgtcaatttaactcgaggcatttgaaataaaacaactgtatttttacattgaaaattatttgttacaggaacttgatagcataatccacaatgtgatgtgaggtacttgtcaaaaattttaaagtttataacacataagtaaacatttgagaggataccagtttgatttgtaaatactc

SEQ ID NO: 48872 - DNA, 324 bp, Homo sapiens
gcagccagggagcagggcatcctgcgagaagagcatcccgctaaggagtctgaacgccatcctgtaggcgggggagtcatcaaggcagggcagaggcaggaccagatggccgtttgaggtgctgagcaaagctcccggtttgcgcggagaggtgagatcgaggccccttgggaggccgaggcttaaccagggctcaagcagaggggagggaaggctggatttcagaggtagggaggataaggaccgtgggtgcacgacggggagggagagccaagtcaaggttaatgccggtgctcgggcggatggtgaaagcagcagatggcc

SEQ ID NO: 48873 - DNA, 408 bp, Homo sapiens
gtaacaggaggaggaggctgtggcagggagtggttccggtgagtcagacttctggacccaggttcgattgcatgccataagacccaccaatgtgtgagcttgagtaacgttccctgagcccttctgcctcagtatactcatctgtaaaatgggtatgttaatagtatccacctcctcccagtgtcgtgaggatgaaatgaactgatcatcgatgtcagagccgtcgaagcatgatggaaggctcacagaaacgtgcactgaatgccctgtgctattatcgccgtgttgacgtgtgattccatccaggcttttgtcctcttccaccatagtcacgctgcatagatcgttttttccctggcttttgccagtcaacaccaccgggagcaccttccagatgacagcatgctt

SEQ ID NO: 48874 - DNA, 472 bp, Homo sapiens
tatatgaactccgcataacacctatggcaaaacatttcagcactcaggtaaaattcattttttgccacaaaattacttaaaaacaggccagaactttatatagctcttgttaaaggttaagtagctgggataataatgaaacaaaaagatgcagcaggactccatttcaaagagagagagtctgtgtgcccaacttcagagtaagaaaccactaggtaatagtttatatagttacttatatgtaatgtggctttattttttaaataaagatttgcatataattgtttatatctgtgaatttatatttaatattaaacacagttttgtaagcatataagatggaaaatgaatgaaatgctcaatcaatgagctgtatgccatgaggattcaaaacagcactttggtgttgccaaaattccggtggtggacttgtgaaggaattccctttggactaggtccactgtagattgta

SEQ ID NO: 48875 - DNA, 353 bp, Homo sapiens
tttccaatgcaataagtagaaggtgtcaaacttggtgaagcttgtcacgccgtatcacattagctcagcactgtcccaagtagatgacacttttaaaatgactttctgcttaaagaatgtgtgtgaaaaagctgcagcattcagcattgtcagaatgttaacttggataaaatcagtcaccacaatgttttgtgcaatggtcctagtaatgtcagaaatacagaaaagctagaaatacaagagttaaagttgctgcctctggctctaggaggaaatgagatagaagacagttaactactctgtttctcttcccccaatcgtgggcatccacaattactttttgatacattctg

SEQ ID NO: 48876 - DNA, 642 bp, Homo sapiens
atggatttttcatggtaaaaagaaggtttgccattaaaatttttgttggttggtttaagttaaagtaggataaatggttccactttggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaa

SEQ ID NO: 48877 - DNA, 284 bp, Homo sapiens
acctctctgaggtttagtatgctcatatgtaaaaagcaaataatatctttccaaagtaatcatcctcaaatgcaagtctcactgtgtctttcccttgcttaaaaccagacacctggcctcttcctacctagtctaacctcattctcatcacttagtcctcctcttgctgcctctcatgcaagaacacaccagcaatattggatagcatgctgtttcacacctctgctcctttgcacatgctgttccagcccccaagaggccttgcctccttccctccttccctc

SEQ ID NO: 48878 - DNA, 372 bp, Homo sapiens
acaggctgggctgtccccacctctcagggaagtgcatctaagtcaggttttcccctctggcacagccctgcctccacagcccaatttccaccatgccacaggcaacccgcatttttatttatttaatttatttatttattgagacagagtcttgttctgttacccaggctggagtgcaatggcccgatgtcggctcatcccaacctccacctcctgggttcaagcgattcttctgcctcaggagagtagggagtagctgggattacaggcatgcaccaccactcccggataattttatatttttagtagagacgggttttctccatgttggtcaggctagtcttgaactccagacctcaggtgatctgcccg

SEQ ID NO: 48879 - DNA, 644 bp, Homo sapiens
aatgagccagtgtcgagaaagtcagaaatagaaatcaataaagctaaatttcaccaagaagaggcagctttgcagtggaatgatagagaacattgaggccaatggatgccaaactcaataatgcacatccttaaactctcacggattagggaaagcagaaaagaaaaccagtgtcttgggaagagtcagaagggatcagagcttgagaatacaccttgctcagtgggaagaggaaggatgggccaagcatcagaggctcagcttcttacggccgggacagcaatagcgtgatgcacaaacctcctgggagccagcgttaaacatcttcataaatcatatgtttgcagctgtgtgaccaaaatagacgtccacccagcctgtttgtcctggccttgtggaatgtggcgtgaccgtaggtcctcaaagacatctgtgattcctgcccctgcttccctcagtgccgttcatcaatcatctgtccaagcctaactctcccctctgattgccagtgacatggtcctactgattgattgattgattgatgattgactgattgattgattttcatatgagagagtttgaagcatattgtgtggagagccttttttatgccagttattcattgaaaaactcgattttcccct

SEQ ID NO: 48880 - DNA, 315 bp, Homo sapiens
gttgggggaagagggatagcataaaacgaacaaaaaagcagaaataagtaagggcaacattttgctggcatgctaatggtaacacaacaaactagctcatggagatggcatattttatcccatggcagccaatgtattagacagtgatggaccataagggagagaaagtgaggagtctgaaactctctcatgacacttggaacaagcactctgtggccctagcagtcctgttcactggtggctgcattggaaaaatccctttggtctgcttttattacatgattttgtgggcattcctattcagtaatctttttg

SEQ ID NO: 48881 - DNA, 1450 bp, Homo sapiens
gtcatcgtcgcacagtcaggccctgccctgggagaagccctgccacacgtcgtgcccacgctgagggcctgtctgcagccctcccaagacccgcagatgcgcctgaagctgttctccatcctgtccaccgcgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaagatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48882 - DNA, 7731 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatttttttttcttcaaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaacactcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcactgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48883 - DNA, 5927 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatt

SEQ ID NO: 48884 - DNA, 7204 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatttttttttcttcaaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaacactcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagcccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48885 - DNA, 5542 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattactcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatt

SEQ ID NO: 48886 - DNA, 7692 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatttttttttcttcaaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaacactcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcactgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48887 - DNA, 6595 bp, Homo sapiens
aattggtttatagtgtacaagtcctattgccttcttggtcttgtgcctagttgttgtgtccattatagaaagaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatttttttttcttcaaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaacactcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcactgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48888 - DNA, 6324 bp, Homo sapiens
ggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaagaaggtactaatgtctcactggaagtatatatatatatatatatatatgtatgcgtgtgtgtgtgtgtatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggtttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatatttttttttcttcaaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaacactcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcactgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccaccaaaaaaaaa

SEQ ID NO: 48889 - DNA, 321 bp, Homo sapiens
aaacataaaagttgttgtttcctattttggcaggaggaacaagtgtttcatatggcctgatgtgtcctgcagatgagacaagaacaattatttctttggacacttcacaaatggtatttaataatttgagatatatttaaaacattttctttattggctccaccttaattgtcattaaaaaagaatctagccactgggcgctgtggctcacgcttgtaatcccagcacctggggaggctgaggtgggtggatcacttgaggtcgggagttcgagaccagccaggccaacatagcaaaacctcatctctactaaaaatacaa

SEQ ID NO: 48890 - DNA, 344 bp, Homo sapiens
tcttcttaggtcatgctcttaaacctcaggtttcctctatttttacatcatttttggacggattaaaaaagttttatattacaaaggtaagaatttttataaaatgctaaaattgtaaatgcttaagatatctgttttctgctttcttcccacatgcacctattataagggtgtttttccatgttgctatgtacatttcagaattacagtttttcatgttggaataaatattaagtaaatcaggcagtcaatttcagaaaattttatttcttttccagttttgaagcttctaaaaataacactgcatttgaacagttttgttttcataacattttctatagttt

SEQ ID NO: 48891 - DNA, 380 bp, Homo sapiens
gaaaaacatagactaacctattaatataaacttttttctcttcttaggtcatgctcttaaacctcaggtttcctctatttttacatcatttttggacggattaaaaaagttttatattacaaaggtaagaatttttataaaatgctaaaattgtaaatgcttaagatatctgttttctgctttcttcccacatgcacctattataagggtgtttttccatgttgctatgtacatttcagaattacagtttttcatgttggaataaatattaagtaaatcaggcagtcaatttcagaaaattttatttcttttccagttttgaagcttctaaaaataacactgcatttgaacagttttgttttcataacattttctatagt

SEQ ID NO: 48892 - DNA, 473 bp, Homo sapiens
caatagaagttttagtaacatgggacagacatgaaaaagattgaatatgtacctataatattgactaatttggtacttcagtgaaggtaaaattcttgttttgcactgcgtcctcagttcacctgttttggcggacaactctaaagcaagccaatgtgtattccttccatggagtagaggctgggaagaaactgagattatatcttaaactaatcatttgggtcgtcttgactttcagtttctagatgttaaatctgatttcacttaacttaaagcccctgtggggattttgtttgttttttagggtgacgcagacttacgatgcaggtgcttgtatctacttctattttgcctttaactacaggggaattagtgacccactgaccgtatttgaacaaactgaggtaattttgcatacctgcatatagcttttacagctgttgattaatttcaataaattttactgtcaattt

SEQ ID NO: 48893 - DNA, 503 bp, Homo sapiens
ctgagttgtttttcctagggtgtgagccacgtctctttgcccatctgcccatttgttttgggctgaatcatgtccccccaacaatgtcacaggctgaagccatcatccccagggactcggaatgtaactgtgtttgtagatacgatgttcacaaacgttgattaagttaaaatggggtcatatgggagggccctaatttaatctgactgtgtcctgataaaaagaagaaatctggacacacaaaaagacccccggggtgcacacagggagtaaaggccaagtgagggcacagggagaaggcaggggctgccagctgcggagagaggcctcggaggaaccagtcctgcccccttgatctcggactcctgcctccaggactgtgggaaaatcagtgtgctggtggctcaagccggtcgaggcagcactgaagacacgtgggttgtttgcaattgttgctgttacacctaaaactgccataaatattcatggtcaatttactgtgt

SEQ ID NO: 48894 - DNA, 608 bp, Homo sapiens
aactagtggatctaatcgacgaggtaggctctatgacaatctgctgtttacggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcat

SEQ ID NO: 48895 - DNA, 824 bp, Homo sapiens
ctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttacggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcat

SEQ ID NO: 48896 - DNA, 388 bp, Homo sapiens
ctagagtgacacaaggaaccaaggtttgtgaggggggatgagagaggctgctgaccccaaagttctgtccaaaggcatccttggtcttcatatgggcttccttacatccctccctccatggtctacacttccttcccatatcctctccttcctcaaactagagtccaaatgttaggtacaataaagggagaaactgaggcaacctccccttcaatgggatctgggtaagcttcaggaaataaataacctcttcacccctctcagcctgagaaggttcagtgaaaaagatgacatgaggcagagcctacactctgaaagccagttccaatcatggtgttggctgttgctgtcattggccttgcctccagcacaggaggccgttactgta

SEQ ID NO: 48897 - DNA, 322 bp, Homo sapiens
tgcactctcgtttcaacaccattggagaaaacacagcccagtgtggctcctctcctactgatgccccacactcggcgtggtccctggagctgcagccctgcctccagatcctagagttccaacttgggcaagcaggagttccatgttccctgctgcctataattctgacttaagctgaaaagggacctttgtttactagcccttttaaagttctatccccaaaccaaaataggaggagtcagcgttctgcggcaagaaccaccttcttagcttttcccaaggtggcagtgagagatgcagagggcaagatttggtcactgag

SEQ ID NO: 48898 - DNA, 355 bp, Homo sapiens
  misc_feature (313)..(314): n is a, c, g, or t
  misc_feature (345)..(346): n is a, c, g, or t
tctacagttttagaccataaaaaaatttattgtcatgattataacccacccaccttgactcaagggaatgatcatatttaaatatatgcaaaattaaagcagaagcattaaacattttttttattttactttatgttctagtatacatgtgtagaatgtgcaggtttgttacataggtatacgtgtgccatggtggtttggtgcacccatcaacccgtcatctagggttttttgttgctgctgttgctgttgttgtgtttgagatggagtcttgctctgttgcccaggctggagagcagtgagctgaagaacnntactgcactccaccctgggggacagaaaagnntccgtctca

SEQ ID NO: 48899 - DNA, 796 bp, Homo sapiens
ggactctgtaattcactcatctccaacagactgttcctctttgccagcacgctaggcaaatttgagaggcataaatgcactctaacaagatgaaagaaagacatggagatggaaatgggactgaaagtggcaaatgtcaacagagaagaagaaaaacaatgaaaatatcacaaatggttcagctaccagctggtaaagtgctttgcctcacaaacaggtagaccagccttccataccagaccaaagcaaaactgtaaagtagataaaacccaggcattatcagtagccaagaagcttcgcaaactgctgagaagaaaaattctccgaaatttcagtgtcatggtaggtgaagaatttaacaagctcaccttaaattatttagttacctagaacataccattgtttgacttgatattactgggattaaagttaagacttggtgaccttacacattaacctgtagatttatatccagtttaaagaaagaaaaacaggcagcagttgtattaccctgtaggacattaaccagtgttggctgtaacctagcaatcatattctggcatgcctttgtaacttacgaatacccagttcctcaaaatgtcctttaaaccaactttacttgattattgtttgccttattaatgatttgcgtttgacatgtattcattttgtttgtataaaatccatggttttaactttttgatatgggccgggcaccgtgggtcatgcccataatcccaaatcccaggctgagctgggcataccacctgaggcagacaagatgcgtcctctagag

SEQ ID NO: 48900 - DNA, 444 bp, Homo sapiens
tactcaagaggctgaggcgagaggatagcttgagcccaggagttttaggctgcggtgagctatgatcatgccacttcactccaactcagcaacagaatgagaccctatctctaaaaaaaaaaataacaaaaataacatttaaaaaatcaacaaaggaattaaaatgggatactaaacaaaaatatttgacagaaatgatagtagtacaggaagaacagaggaacaaaacagatgagacatttaaaaaaaaaaaagaaaaagaaactttgagtacagagagaagtctagacccagataactttacagctgaatgttttcaaacataagaagcattattacatacattccaaaagactttgtattagggtaatggtagagaaaatgctttcagctcatttctgttagtccagtattactgctaccaatactaggcaaaaaaaaaaa

SEQ ID NO: 48901 - DNA, 550 bp, Homo sapiens
gagacaagagttttgctcttgtcgcccaggctggagtgcaatggcatgatcttggctcactgcaaactccacttcccgggttcaagtgattctcctgcctcagcctcctgagtagctaagattacaggtgcataccaccacgcccagataaattttgtatttttagtagagacaggccaggctggtctcgaactcctgacctcaggtgatccacctgcctcggcttcccaaagtgctgggattataggtgtcagccaccgcgcccggcctacaaaggaaatttatgatcaacttgctatcaataaattgggcaaatcttgcaaagacatacattacaaaaaaaggctcaaaaaaaaaaaagaaaaagaaactttgagtacagagagaagtctagacccagataactttacagctgaatgttttcaaacataagaagcattattacatacattccaaaagactttgtattagggtaatggtagagaaaatgctttcagctcatttctgttagtccagtattactgctaccaatactaggcaaaaaaaaaaa

SEQ ID NO: 48902 - DNA, 1567 bp, Homo sapiens
aaaagtgcagatcacttaaacggcctgcttcgggaagtagaggcaaccagtgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttacaaaaatggttcatgtgtattaccatcattcttttgtcaaaaagtgtgtatatgtttgcatttacatatatttgtacatctatatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgtttgaggctagtgagctgtgattgtaccactgcactccagctcggggaacagagcgagaccttgtctctaaaaataataatagtaaaataaaaataacattttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctaatgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataagctttccatcagaagggattttagacaccttagaggtccgtgctacatcttcacagttcctctgaataaccttaggtggtagtgttacttgcctttgacaccgctgcatatgttttaatgactagatccaaactgtgttgttcttaaatcaaaaattggataatttttaatatttatgtattaatca

SEQ ID NO: 48903 - DNA, 427 bp, Homo sapiens
aaaagtgcagatcacttaaacggcctgcttcgggaagtagaggcaaccagtgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattaaaa

SEQ ID NO: 48904 - DNA, 190 bp, Homo sapiens
gcttcgggaagtagaggcaaccagtgcagtccttatggagcaaattaaggtgagatcagaaaacctggccaccatgaaaactgccaatttggttttctggaccctccatacacatgtacccaagtttaaaaattcacattgcagatgcatctataacgtcttgatctttatattagattcctgatggtga

SEQ ID NO: 48905 - DNA, 1706 bp, Homo sapiens
ctcaaatttaaatctaattctcaagtctagttattttcctactgtgccacagatacaaacttttgtgttttaatgtttattgttctgcttatcaaagaaagaatgtaaacttatgattctgttttgctttgtttaaaaatgtgattcagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48906 - DNA, 960 bp, Homo sapiens
  misc_feature (15)..(15): n is a, c, g, or t
gcaggctggtaccgnccgggggttagggatcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaacatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgacccaattctggatcacgaacattctcaggaacgtatggtgttccaggtctagaacaccttcttgaaaattctctaaaagagcactgaagttacgtcttttgacctgtcccagg

SEQ ID NO: 48907 - DNA, 2602 bp, Homo sapiens
  misc_feature (15)..(15): n is a, c, g, or t
gcaggctggtaccgnccgggggttagggatcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48908 - DNA, 1928 bp, Homo sapiens
ggactcccgaggcatccccagtgttgtaaagagctttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48909 - DNA, 1821 bp, Homo sapiens
  misc_feature (23)..(23): n is a, c, g, or t
gcagtctgtacgccagggagtanggatattgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48910 - DNA, 1868 bp, Homo sapiens
  misc_feature (15)..(15): n is a, c, g, or t
gcaggctggtaccgnccgggggttagggatcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagaggtatgtcttacagacattgagtttttccagatcgttaacatttggaaaactcaccacagcaaatcttggagcaggaaggatattgaagagttaattgttaaattttcaaatagtttctttagtcattctgccttttggtttacagtgccatctccactgttggcattactattttacaaataagttgacgtttacccctagcaaattttcatcagtgtgcaatatttttttctaatgtaaaaatagcctaaaatggtgggacaaagttttccctaattcttcatacaataaatgaagcctctgaagaggcttgctttttcttaaaa

SEQ ID NO: 48911 - DNA, 3099 bp, Homo sapiens
  misc_feature (15)..(15): n is a, c, g, or t
gcaggctggtaccgnccgggggttagggatcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48912 - DNA, 2949 bp, Homo sapiens
  misc_feature (15)..(15): n is a, c, g, or t
gcaggctggtaccgnccgggggttagggatcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48913 - DNA, 1925 bp, Homo sapiens
atgactctagaggaccccgacgtgtctcagctttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaataaaaaaaaaaaa

SEQ ID NO: 48914 - DNA, 458 bp, Homo sapiens
  misc_feature (413)..(413): n is a, c, g, or t
acattctgagtggggaaagggactaaggtggtctgaggaccccacagagtcaggaagattgagagagtgcccctccggcctcgccatgaggctcttcctgtcgctcccggtcctggtggtggttctgtcgatcgtcttggaagcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccnattgccccaggtgccaccaataaaaatcctacagaaaaaaaaaaa

SEQ ID NO: 48915 - DNA, 283 bp, Homo sapiens
acggtacaggaaaataacctgtatgcattgcatgcctgggttttttgttggtttgggtatttttttgtttgtttttgctttcttttgaattagtacaaaaacctgaggagttttactagaaaccccgtatcttgatgaggcagacttattttatctgaaacctgcttaacctttgggcagctttttagtttgggaagtcaggttacactatttgtccggaaaataattagcatcagtccataaatctgggacataaaatgtttccctttggaggatgtaaaag

SEQ ID NO: 48916 - DNA, 761 bp, Homo sapiens
ggacgcgtgggtccggacgcgtgggtcgacccacgcgtcgcggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaccggtcggacagggacaccaggtggaacaagggcatgcccggatcagggagggcacgtacgtggcagccagggacacgcgcagagccgggcggtacacgc

SEQ ID NO: 48917 - DNA, 1028 bp, Homo sapiens
ggacgcgtgggtccggacgcgtgggtcgacccacgcgtcgcgtgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcagacaaggagactgcttcatgccagtgatttctgacctcggcaataagcggtatgccgttggttgccacggtctgatacatggacagaaataagcgtgaaaggaggcaatagatggataggatatgacacttggacacaccgtaaggaaaaccggaagaatgggctcccactcctgcggtctaattggg

SEQ ID NO: 48918 - DNA, 1181 bp, Homo sapiens
  misc_feature (873)..(873): n is a, c, g, or t
cccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgggctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaactgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgtnggtactgttctgttgccgatggagactggggtctcaacccggatggtggcaccttgttcagtcacgtcacggagtaaactgcgaatccctgaacttgatgactctctgggcatgggctccaatgcaagaatggctgcaggagttcgcctggacgtgcgggacgcaaaggcccacggggcagggctcccgccgggaccggaaccggcaaaaacgaccgtgtgccaggcattcatgggaacaaagctaagaagcaaaacaggggatcccagacacacctggaggacagcgccgatgaccacaaacacaaa

SEQ ID NO: 48919 - DNA, 1150 bp, Homo sapiens
  misc_feature (1006)..(1006): n is a, c, g, or t
  misc_feature (1091)..(1091): n is a, c, g, or t
  misc_feature (1105)..(1105): n is a, c, g, or t
  misc_feature (1134)..(1134): n is a, c, g, or t
  misc_feature (1150)..(1150): n is a, c, g, or t
cccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgggctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgatttgggggggaattgggnaccggtttcccggtttggcccaaattggaaaacctggggggttcctcaaaaaccccggtttgggggggccaccctttgctccaanttcaaacggtttancaaccgggaaagttaaaaatcctggtccnaaaattggcacccaan

SEQ ID NO: 48920 - DNA, 737 bp, Homo sapiens
  misc_feature (734)..(734): n is a, c, g, or t
  misc_feature (737)..(737): n is a, c, g, or t
cacgtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttgctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgcctggtccagggatgaagtccgtaggatgcatgcagtgaccacgctgtgagcttgatgatctacacaactgtcctggcctgcgctgcntcn

SEQ ID NO: 48921 - DNA, 978 bp, Homo sapiens
cccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgggctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttgggccgcatggcgggccacatggaacatggcctggtcacggagggaatcaccgtcagatgcgagaccagaaccccggcagagagcgaacggagcaaccacggcgcaaagaaacgacacagcggcccaggaagaccacagggagaggacaaaccgagggcaccaggggagggactcc

SEQ ID NO: 48922 - DNA, 1760 bp, Homo sapiens
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48923 - DNA, 1772 bp, Homo sapiens
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48924 - DNA, 1788 bp, Homo sapiens
aagacttagagttctaggagtccgagtccgcgtgtgcttaaattcggcactgatgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48925 - DNA, 1758 bp, Homo sapiens
  misc_feature (21)..(21): n is a, c, g, or t
  misc_feature (27)..(27): n is a, c, g, or t
  misc_feature (41)..(41): n is a, c, g, or t
tcccaggggctcgataaactnacggcnaaggtagcgaggcngggtgtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48926 - DNA, 1955 bp, Homo sapiens
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaagaaatcggctcttttcggggcggaaaggggatgaatggcatggcttgcttccggaccgttttgtcacaaggtaactggggcccatgggccgtatcgtagccggactatgatctcgcgcacactaagttcgctggccctaacacgggagcaaaaacaaaacgctgctatttgcgcatcatcccaacc

SEQ ID NO: 48927 - DNA, 1869 bp, Homo sapiens
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaagaattttcttctatttttaataatcttcgggggggtcttctattaaataaaaataaattgcattgcggccgcattttcggctaacttggccaatttcgccctatagggg

SEQ ID NO: 48928 - DNA, 1709 bp, Homo sapiens
  misc_feature (1632)..(1632): n is a, c, g, or t
  misc_feature (1650)..(1650): n is a, c, g, or t
  misc_feature (1656)..(1656): n is a, c, g, or t
  misc_feature (1670)..(1671): n is a, c, g, or t
  misc_feature (1680)..(1681): n is a, c, g, or t
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggacttatntggattattaaataatgngagtgnacagtttaaagatnngtagcaaanntatgcagaaatacctagcgtgggagcaa

SEQ ID NO: 48929 - DNA, 1737 bp, Homo sapiens
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccgtaggtcgacctcggtatctcctttatagcgtgggcagattcactgaggtacttacaatatccgtacttgtgtaagtgatacgtgcatatgcatcaatcaccagctgcc

SEQ ID NO: 48930 - DNA, 1656 bp, Homo sapiens
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaactgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48931 - DNA, 1841 bp, Homo sapiens
  misc_feature (240)..(240): n is a, c, g, or t
  misc_feature (273)..(274): n is a, c, g, or t
  misc_feature (284)..(284): n is a, c, g, or t
  misc_feature (286)..(286): n is a, c, g, or t
  misc_feature (289)..(289): n is a, c, g, or t
  misc_feature (296)..(296): n is a, c, g, or t
  misc_feature (302)..(302): n is a, c, g, or t
  misc_feature (306)..(306): n is a, c, g, or t
  misc_feature (312)..(312): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggancagggctccttcaagtaatgcctgggtcttggnnttaaacttgnanagnctggagnccgtgnaacngttggntattcaacccatttggaattaattcctccccttttggttggggaaaacaacttttttcggaacggaaccccaagctgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48932 - DNA, 1393 bp, Homo sapiens
gtacatctagaagatgatcaaccggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48933 - DNA, 1812 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttaccaacaagcatggggggaatgggaatggaacaaacgcaaagcctaaacaatatgggtcagagagtggtattaaacaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48934 - DNA, 983 bp, Homo sapiens
  misc_feature (865)..(865): n is a, c, g, or t
  misc_feature (884)..(884): n is a, c, g, or t
  misc_feature (888)..(889): n is a, c, g, or t
  misc_feature (891)..(891): n is a, c, g, or t
  misc_feature (894)..(894): n is a, c, g, or t
  misc_feature (899)..(899): n is a, c, g, or t
  misc_feature (906)..(906): n is a, c, g, or t
  misc_feature (912)..(912): n is a, c, g, or t
  misc_feature (915)..(915): n is a, c, g, or t
  misc_feature (917)..(917): n is a, c, g, or t
  misc_feature (921)..(922): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgggggnttgggctgtccgtggggcnaggnnanggnggtcncaacggntggggnctngnccgnnagtaagggagaatcggaagccaagggaggacctcggaacggcaccaaagtagcaacaaaga

SEQ ID NO: 48935 - DNA, 1043 bp, Homo sapiens
  misc_feature (865)..(865): n is a, c, g, or t
  misc_feature (868)..(868): n is a, c, g, or t
  misc_feature (874)..(874): n is a, c, g, or t
  misc_feature (879)..(879): n is a, c, g, or t
  misc_feature (888)..(888): n is a, c, g, or t
  misc_feature (891)..(891): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgtgggnctngtccgntgccngtggcaggngtnccacccggttgtggtcccttgctccagacttcaacgagtaattgtgaatggcagaatttgggaactccgggaacgggtccgcacatgttgccgttctcggcatttgggcaacccccaacggtgcgtgtttataccaacgcccggcttgtgca

SEQ ID NO: 48936 - DNA, 1023 bp, Homo sapiens
  misc_feature (879)..(879): n is a, c, g, or t
  misc_feature (964)..(964): n is a, c, g, or t
  misc_feature (978)..(978): n is a, c, g, or t
  misc_feature (1007)..(1007): n is a, c, g, or t
  misc_feature (1023)..(1023): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgatttgggggggaattgggnaccggtttcccggtttggcccaaattggaaaacctggggggttcctcaaaaaccccggtttgggggggccaccctttgctccaanttcaaacggtttancaaccgggaaagttaaaaatcctggtccnaaaattggcacccaan

SEQ ID NO: 48937 - DNA, 914 bp, Homo sapiens
  misc_feature (834)..(834): n is a, c, g, or t
  misc_feature (870)..(870): n is a, c, g, or t
  misc_feature (894)..(894): n is a, c, g, or t
  misc_feature (909)..(909): n is a, c, g, or t
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactggaacaaagcccccntttgcgccctggccctcctcccaaaggaattgttcnaaacaaaaaaatttgggggggggnaaatttggggaaacngggtt

SEQ ID NO: 48938 - DNA, 1076 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaacaacaagaaccacacgacagcacaagaaccacacgagcacaagaaccacacgagcacaagaacaggctggtctcaaatgcctggcctcaggtgatcctcctacctcagagagaggatcttgccatcctcccaaatgttgagattacaggcatgagccactacgccagccagattctgttacttctattttgtagataaactaaggcagaaaaatgatttcattaacttaaataatttgtccaggtaacatagctagtaagttacatagctgggatttaaacccagcagtttaacggaaagccagcac

SEQ ID NO: 48939 - DNA, 870 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaatttccacaaggagatatcaatggtgataccacgttcacgctcagctttcagtttatccaagacccaggcatacttgaaggagccctttcccatctcagca

SEQ ID NO: 48940 - DNA, 899 bp, Homo sapiens
  misc_feature (720)..(720): n is a, c, g, or t
  misc_feature (725)..(725): n is a, c, g, or t
  misc_feature (728)..(730): n is a, c, g, or t
  misc_feature (733)..(733): n is a, c, g, or t
  misc_feature (742)..(742): n is a, c, g, or t
  misc_feature (754)..(754): n is a, c, g, or t
  misc_feature (756)..(756): n is a, c, g, or t
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccngggcncgnnnggnaagcaccgnaggaggcatgcngngaacaagcgctgaaggccgacggaccacaacaacgtcaatgaaagccgagcagctccggagtcaaagcggggacggagcgcccggcagaggacggtccaccgaagggcccgcacgccagaagcagaccaacggccgggaggcc

SEQ ID NO: 48941 - DNA, 423 bp, Homo sapiens
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctcctagggtggagagagggagagagccaggcatacttgaaggaggctgctgagatgggaaagggctccttcaagtatgcctgggtcttggataaactgaaagctgagcg

SEQ ID NO: 48942 - DNA, 973 bp, Homo sapiens
  misc_feature (867)..(867): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgggtgttncacatgggggtttggacgtccgatgacacagggaaggggttcacaccggtggggaccttgtccaacaagtaggaataaattaggagggccaaactgagacctcgga

SEQ ID NO: 48943 - DNA, 526 bp, Homo sapiens
cctgtaataggagctcctattccgctcggtgtggaaatttgagaccagcaagtactatgtgactatcattgatgccccaggacacagagactttatcaaaaacatgattacagggacatctcaggctgactgtgctgtcctgattgttgctgctgaatggtgacaacatgctggagccaagtgctaacatgccttggttcaagggatggaaagtcacccgtaaggatggcaatgccagtggaaccacgctgcttgaggctctggactgcatcctaccaccaactcgtccagagcggaccgtccgctcggacgaaggagggcgcaactgtgtgaggagaacatgcggggtgtgcgcttcgacgtccacgacgtcaccctgcacgccgacgccatccaccgcggagggggccagatcatccccacagcacggggctgcctctacgccagtgtgctgaccgcccagacacgcctcatggagcccatctaccttgtggagatccagtgtccagagccaggtggtccgagc

SEQ ID NO: 48944 - DNA, 1022 bp, Homo sapiens
  misc_feature (843)..(843): n is a, c, g, or t
  misc_feature (848)..(848): n is a, c, g, or t
  misc_feature (851)..(853): n is a, c, g, or t
  misc_feature (856)..(856): n is a, c, g, or t
  misc_feature (865)..(865): n is a, c, g, or t
  misc_feature (877)..(877): n is a, c, g, or t
  misc_feature (879)..(879): n is a, c, g, or t
cccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgggctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccngggcncgnnnggnaagcaccgnaggaggcatgcngngaacaagcgctgaaggccgacggaccacaacaacgtcaatgaaagccgagcagctccggagtcaaagcggggacggagcgcccggcagaggacggtccaccgaagggcccgcacgccagaagcagaccaacggccgggaggcc

SEQ ID NO: 48945 - DNA, 1755 bp, Homo sapiens
ggacgcgtgggtccggacgcgtgggtcgacccacgcgtcgcggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48946 - DNA, 1776 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48947 - DNA, 1758 bp, Homo sapiens
tcccgttaccgtccgcagaagtgaatttgcgctgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48948 - DNA, 1750 bp, Homo sapiens
gggaccctggggtggtgttaaaacttcggacgaggctgtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48949 - DNA, 1757 bp, Homo sapiens
  misc_feature (1735)..(1735): n is a, c, g, or t
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttaggtacgtctatatactgtcagtaaatttataagtgacagtcatctgacctcaaaatgtgttaccgcanggtagacacacaataaagaacg

SEQ ID NO: 48950 - DNA, 1772 bp, Homo sapiens
  misc_feature (1769)..(1769): n is a, c, g, or t
gtagagcctagtgcgaggcctggtggtggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggacatatattaattttattgtcgatgtggacaagtatatataaagtgaggtagcattaaatattgcaagtacattacttaaggtgggagctagtcatgcaccaaaaatgttaacgctgagtatgagaccaccataacgatcaaantgg

SEQ ID NO: 48951 - DNA, 1665 bp, Homo sapiens
ggacgcgtgggtccggacgcgtgggtcgacccacgcgtcgcgtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48952 - DNA, 1810 bp, Homo sapiens
  misc_feature (424)..(424): n is a, c, g, or t
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcagcttgacntggtttggggggccccctttttggggggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48953 - DNA, 1614 bp, Homo sapiens
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctcctaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48954 - DNA, 1725 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48955 - DNA, 1170 bp, Homo sapiens
  misc_feature (862)..(862): n is a, c, g, or t
tggtccggatcaggagtgctgggttggtcaaaattgtgcactgatgggccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgctctccaggatgtctacaaaattggtgtnggtactgttctgttgccgatggagactggggtctcaacccggatggtggcaccttgttcagtcacgtcacggagtaaactgcgaatccctgaacttgatgactctctgggcatgggctccaatgcaagaatggctgcaggagttcgcctggacgtgcgggacgcaaaggcccacggggcagggctcccgccgggaccggaaccggcaaaaacgaccgtgtgccaggcattcatgggaacaaagctaagaagcaaaacaggggatcccagacacacctggaggacagcgccgatgaccacaaacacaaa

SEQ ID NO: 48956 - DNA, 889 bp, Homo sapiens
  misc_feature (834)..(834): n is a, c, g, or t
  misc_feature (845)..(845): n is a, c, g, or t
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccatgaaagccttggctgctntcagagttacnaatggggttggcggcggggcgggaagggtttaaccgtggggtca

SEQ ID NO: 48957 - DNA, 958 bp, Homo sapiens
cttgtcagttggacgagttggtggtaggatgcctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 48958 - DNA, 801 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgcctggtccagggatgaagtccgtaggtggaagccggaccaccgtgagccggaggtctaaccaacgcggccggcgcgccgtcggg

SEQ ID NO: 48959 - DNA, 607 bp, Homo sapiens
ggacgcgtgggtccggacgcgtgggtcgacccacgcgtcgcggggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaacactagcacctcagcagagggataggatgttaggagtagcctcataggaat

SEQ ID NO: 48960 - DNA, 952 bp, Homo sapiens
ggcattggagtgatgctgggccctgctaactcaccatgtgaccctaggccttagtgtaccctgagcaggctgtgctcttaggcccaggccagcccacagcctgtgactgctctgtcctgcctgtaggtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaa

SEQ ID NO: 48961 - DNA, 2771 bp, Homo sapiens
cgcgtccccagaagggggcggggagagacgagggttggcgggctcagggggcgggggcgcagggcagcgggggcggggcggtgtcccgggaccacccccggcctcctcccaccgcggtccattcaggtccctgcaccgcactccgctcggaccccaggccgccggtgctgtcgctactcaagtgagtcccgcggtgcccctcccgccgcgccgcccgtcgggcatggactcgggccgggacttcctgaccctgcacggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaa

SEQ ID NO: 48962 - DNA, 2731 bp, Homo sapiens
ccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaa

SEQ ID NO: 48963 - DNA, 2807 bp, Homo sapiens
ccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggtgggagtcccctggcaggtgaggagtgggatgctaggggtggcccaccactcctaaatgtcccttgggcctccaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagattaa

SEQ ID NO: 48964 - DNA, 282 bp, Homo sapiens
gagatccatggcgtgagccgggacgtggccagccgccagactgctgtcatcaccaacaatggtaggtgctgggcctgggctgggctactagggctggtgtccatgctgctgatatggtgcctgtccccctaggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaag

SEQ ID NO: 48965 - DNA, 457 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 48966 - DNA, 3159 bp, Homo sapiens
  misc_feature (3117)..(3117): n is a, c, g, or t
  misc_feature (3124)..(3125): n is a, c, g, or t
  misc_feature (3130)..(3130): n is a, c, g, or t
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaacaanaacaaannaaacnacaaagaaccaacaaaacaaaaagggggg

SEQ ID NO: 48967 - DNA, 3106 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 48968 - DNA, 2830 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaa

SEQ ID NO: 48969 - DNA, 2416 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacacctgtaatcccagcacattgggaggctgaggtgggtggatcatgaggtcaggagttcgagaccagcctaaccaacatggtgaaaccccgtctctactaaaaatacaaaaattagccaggcacagtggcgggcacctgtaatccctagctactcgggaggctgaggcaggagaattgcttgaacgcaggaggcagaggttgcagtgagtctgagatcatgccatctgcactctagccaggatgacagtctctcgggtggatcc

SEQ ID NO: 48970 - DNA, 622 bp, Homo sapiens
  misc_feature (1)..(1): n is a, c, g, or t
  misc_feature (32)..(32): n is a, c, g, or t
  misc_feature (34)..(34): n is a, c, g, or t
  misc_feature (36)..(36): n is a, c, g, or t
  misc_feature (38)..(38): n is a, c, g, or t
nggcgcaatgaaggtgaaggccggcgcgcccngngntnggcgattcccgaggcctctccagtccagagcctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48971 - DNA, 2378 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48972 - DNA, 2326 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcacaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48973 - DNA, 2523 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48974 - DNA, 2745 bp, Homo sapiens
ctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48975 - DNA, 2953 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaataaaaacaacacacacaaaaaaaaaaaaaaaaaaaaacaacaacaacaacacccccacccccacaaaccaaacaaaaagaggggggggcggacagaaaatatcccccgcaggggacgaacaaaagagcacaccacagaattgtgcacacgagggcgcccaaaagaggagcgcaataaaacacaacaccgcgcgcacataaacaaaagacgaagaagaggaaaactcgccccaggagaaactggagaagaagacaacatccggggggagcgaaacatggggcaacactatccccggagaagttaaaccgcctggggccaccatacaatccagaggacataggcggataacagcgtacttgtccgaaaaagagtgtccagcggatatttgaaactagcggcatcagcaacacgcaatgagtacaaagagtcacg

SEQ ID NO: 48976 - DNA, 2491 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48977 - DNA, 2367 bp, Homo sapiens
gccacctcgctcagcagggcctctcaggggtcctcagtctggcccaaggaccagggcctcagcctagccccaagagtgggccacaaccttcagcttcctgctgggaaaacccaggagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48978 - DNA, 2248 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 48979 - DNA, 968 bp, Homo sapiens
tcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacaccaaccacctagattcagcccccctcccgaaccccgagatggggtaggagtggaggtactcttttatgccctgaatgagcccccagcctgatggagccccaa

SEQ ID NO: 48980 - DNA, 285 bp, Homo sapiens
aggacagcctactgggattagaaactaaatatcttggggggttattacttagcctactatagagaataatagtgtttatggaaagaaaatttccttttccagcaccttccccaaagccaagtaagagagatctccataaaattacttgttgtggaaggcactgttgactgcctctccccagccccaaaccactgttcttttgcctgttctactacacagactacaaaagctaaatccttactatcccagctgcccctatagctaatgatagccatgtggtagcat

SEQ ID NO: 48981 - DNA, 490 bp, Homo sapiens
aattttaaaacttcttaatgttgcctggaatacatgagtcttcctgatctcttcaaacggggtttgttttgttttgctttggggagaattcttttgacgtttttgaataagctgttaacaactttaatacctgtcttgtttgttttcttcagaaatttgttaattctccatgattagcacctttatgtggttatctcattattttcattcctttttaattctctgttttaggaatgcttgtcaaattcgtcactaaaattgatttactttcttgaaaacctgtttctgctgctcccaacatgatttaatcttggctactgagcttttggttacgttgcactccctttaaaattactccgtttaagtacagtgttcactctttgggtaatgtgtacaatagaagcccaatccccacctatacccaatatatccatgggacaagcatgtacatgcaccccctgagtctaaaataaaaattttaaaaaaacta

SEQ ID NO: 48982 - DNA, 441 bp, Homo sapiens
ggacattccatttgacttccagagccaaccctctcagcctagtgccagggagggaagggctctcttcatatgcgcccacgctgcatgaggccgggggcagctgggcctggcagacccccagaagtacatggggggcagaagacagtccccagaggcaagggtgctggacagaggggaggagggatgctgagccaaccccagggcagtgtccccacttggcatatgacttggcaacatctacaaaggtggccgtgggacatggccctggcccatgggtcactaggcacagcgccccaccccactcccccgcatccagtgcagcaatgtccggtcgctgagaaatgctgatggaaccctggacagcaggggtcacagaagtcaggctgggggtcacctttcttccagcaccgtcttctggttttacgtgtgaggaaagggaga

SEQ ID NO: 48983 - DNA, 722 bp, Homo sapiens
  misc_feature (590)..(590): n is a, c, g, or t
  misc_feature (716)..(716): n is a, c, g, or t
ggtggggtctcgatgtgttgcccagaccagtcttgaatgcctggccataagcagtcctcccaccttggcctcccaaagtgctgggattacagatgtgggccaccactcccagccgggatttttttaattatctaaaatagttttgaatatatttagggccttttagaattttaaggtatctctatttcttgcaggagtaactattataaattatgatgaccttctacattatgtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaanacttccttaatgggaattaaaatgacaactgtagctctgtcatcaacatctcaaactgccacagcactcactgtgcctgcaatttcttctgcatcccacccccaagaagaactgaataccccattnctgagc

SEQ ID NO: 48984 - DNA, 319 bp, Homo sapiens
cccccgggctgcaggaattcggcacgttgttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48985 - DNA, 4359 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48986 - DNA, 3724 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccacaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48987 - DNA, 2380 bp, Homo sapiens
atctagaacatttctattatccaaaattctactgggcaacactgatatatgtagaagatacaaagatctcctgattgtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48988 - DNA, 2718 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcgtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48989 - DNA, 2333 bp, Homo sapiens
ccaaagtgctggcattacaggcatgagccaccacgcccagcctcgtagtcatttctaaaagatctgtattcctattttttttgttatgtgaatatttaatcacttctttatgagctctgtccccatgtgacctttctcattacatgtatttattactgctttcagaaaatatctaatgcaagcatgttcttttcttcctttcatcatattaaggacataataatatttcctttcagtccctttaggttgtacttaggtttttttcttttgttttataacaccaagtttttagattatttcattaagctattatgtcactacttacaaaccatggaaatattgctgtaaatatataaaagtaggtcattatattgaaataatttacggttcaatgtggaaaatattagaaaaacaaaatatttgattttgattttaaatattatctatttttgttttgcctctttgtttgccctcagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48990 - DNA, 1791 bp, Homo sapiens
tacacattcccaggatgaggtgaactttcaaatatcaattttaaggctattgattatattgggaaaaatgaacaatgacttggatgttaatgtgtgtgttttccttttttaagggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48991 - DNA, 1728 bp, Homo sapiens
  misc_feature (18)..(18): n is a, c, g, or t
  misc_feature (27)..(28): n is a, c, g, or t
ccccccccttgggggggncaaggctanncatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtataaaaaaat

SEQ ID NO: 48992 - DNA, 2545 bp, Homo sapiens
  misc_feature (2413)..(2413): n is a, c, g, or t
  misc_feature (2539)..(2539): n is a, c, g, or t
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaanacttccttaatgggaattaaaatgacaactgtagctctgtcatcaacatctcaaactgccacagcactcactgtgcctgcaatttcttctgcatcccacccccaagaagaactgaataccccattnctgagc

SEQ ID NO: 48993 - DNA, 2117 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcagagttcagatgtacggactggctaccttggaaaggcgccgcaaaaggtatactctagagtcac

SEQ ID NO: 48994 - DNA, 3450 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcata

SEQ ID NO: 48995 - DNA, 1275 bp, Homo sapiens
gacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaatactatgtacagcagggtacagagctcgattctatcatg

SEQ ID NO: 48996 - DNA, 2412 bp, Homo sapiens
agcggaggagcggggaaggctcaggacagggtcttgctctgtcgcttaggagtgcaatggtgtaatcttggctcactgcaacctccacctcctgggcttaagcaattctcctgcctcagcctcccaagtagctgggaccagagagacagggtctctctttgttgtccaggttcagcttcaagtaatcttacagcctcagcatcccaaagtgctaggataacaggcatgagccatgacacccagccaaatattcttactggtactttatattgtgtattttaatcagattgtctagtccttctaacagccgtgaaattagcaaaatggctggccatccaaatgcaaactgatacaattcttttggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacaggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttcatttctcccaagcagc

SEQ ID NO: 48997 - DNA, 2764 bp, Homo sapiens
gaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaaaaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacaggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttcatttctcccaagcagc

SEQ ID NO: 48998 - DNA, 2759 bp, Homo sapiens
gaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaaaaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacaggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaatctatcctgttctaacaggtgactatatataatatatttataattatgttttacaagatagtattttctgatgatccatactaacttatcttgtcctacagaaggcattactaatcgatattattaaagatgctagagcccctcgatccatttatattgctattgtaaattcttgtttgttgagtaaaatgtttaaatactatatgtatctcatgtacaaagttgacatacattatattcatgtacataaaattaaagagattagattatatactgttcatttctcccaagcagc

SEQ ID NO: 48999 - DNA, 458 bp, Homo sapiens
agagaagggagcaatataagccctgcgcagaaagagtttcaagtatcatcatgaatcacacttacactttggtttacttgaccaaaacaataacataatgttctactaaaatcctcggaagcacaaacatattctcaaattattggtttcttatgaatggagttataagcagagtctggctatcagagcatgtttatacatctccatagggcttaggggaaggacaactgtctaaaggttttagtgtattttaaatctatttagaggtaaatcaaaagattttgaaatgttttgaatggcaatgcttaattctgggagtttgggtataatgttgctcacgtacaaaatgaggtcccttaaaggcagaaacatttctgaagaagaggtagatctcctctgtctacagaataacccatctaggctacttaaaccataagcgttgtaggctctgaagagga

SEQ ID NO: 49000 - DNA, 583 bp, Homo sapiens
gccatctctactaaaaatacaaaacattagccaggcttggtcatgggcacctgtaatcccagctacttggtacgctgaggcaggagaattgcttgaacccgggaggcagaggttgcaatgagccgagatggcgccgtcgcactccatcctgggcaacaaagtgaaactccatcccaaaagaaagagtatcagcgataaaggcaaagctctttccagaaaaaaatggttttatggcctaagttctaaacaatctccgtggttactgttggattttatgtagtaagtatatgtaagcttcaaattcatcacatctttattatttatcctttcataaatattgtgttctacattgacattaatctggagaactcccggttatgcacttggccccaacatgcacagactcaggggcgtgttcttgttgcaagagtaagtgtgcgatggttcagatcccttggacgtccttatgtctccaacctcagtgggcacttattacctgcttctggcatgttaaacagtaggatttgaaacaaaaaatggataggcgtagtgggtttgtaccaaacaaaaaaccagaacttga

SEQ ID NO: 49001 - DNA, 410 bp, Homo sapiens
aaaaggatttgtacaccgaatgacttcaggatttctggtgtgttgtgagaaatatggtataaacactgtactatcactcttagcattcaaataaaatggatttcagcagggcgtggtgtctcacacctgtaatcccagcactttgggtggttgaggcagatcacttcagcccattagttcaagagcagcctgggcaacatagtgagaccatctgttgaaaaaaaaaatagccaggcatggtggcatgcacctgtagtcccagctattcaggaagctgaagcaggaagatcacttgagcccaggaggttgaggctgcagttagctgtgattgcatcacgctgtgattgcatcacactgcgttccagcgacagaatgagaccctgtctcaaaaaataaaataaaatacaatg

SEQ ID NO: 49002 - DNA, 296 bp, Homo sapiens
gaaaactctcctaaaccattactatacctcctttccttagccttacatttacttctcttctgcttagaacccttgttttgcccactagtaatatagggtgagatggatggtagagttcctctaagagttgggaataggagggaagttcctgtatctcttaactcacatttagtctccttatctacctgcaaagctgtcatgctcatcttcaccacaaagtctttttttctgattttttttttttttgagacaggatttggctctgtgactcaggctgtagtgcagtggtgtgatca

SEQ ID NO: 49003 - DNA, 225 bp, Homo sapiens
gtgttatttcctcctatcccaggccttctcaaatacctcccttgactgtgccttatacattgtctgttataattacctttcttgagaatcatagtatttggttggcttttctccagtgaatagaattaacctagtgcaagcagtttttcaaagcatataatgagccttttaaaacttgaattttcatgacaaagtttattttgttgaaatataaaagaaaggcaa

SEQ ID NO: 49004 - DNA, 895 bp, Homo sapiens
gcggtggtgtcccgaaggcctcactgtttctgtcgcgtggcccgctcagctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgt

SEQ ID NO: 49005 - DNA, 371 bp, Homo sapiens
ccccgctgagctctggtgagacaacaggaacgcagtcgaggaactttctgcatgacgcctgcctgtaaccaccttgcccccacaactgcagagttctggagcctgcagcgccgagtgttaggaaattctcacagcacaggaagggtgctaattggccacacttgtgcttagtttgttgttgttatcggatgacagttatctttctcttctgccaaacacatatgcaataaactgaaacaaggttcaattcccatggtatattctgaagctaaaatctagatagtgtaaatagttgcccttaggtgtaactccaactaagttaaattaagaactcaatgatagggctgggtgcagtgtctcactcctgtaat

SEQ ID NO: 49006 - DNA, 336 bp, Homo sapiens
aggccatcccacctgggctaatttaaaaaagatgtttttgtagagacaggggtcttccctatgttgtccaggctggtcttgaacttctgggttcaaaggatccacctgcctcagcctcccaaagtgctgggattacatcgtggcatgagccaccatgcctggctgctaggtgagtcttaaagcttttaggacttatttccttctccccagcagtaccccatcccctttcagcatcacacagggttttctagtccagccctttggtgtcatttggagttagctgtggagtcaggagtaggtgaggggctggacagaacacctacctgtagggaacct

SEQ ID NO: 49007 - DNA, 860 bp, Homo sapiens
ggacacagtctccctctgtctcccgggctggagtgcagtggcgccatcatggcttgctacagcctcgagcttcaggactcaaacgattctcccacctttgcctcctgagtagctagggctacaggcatgtggcaccacgcgcaggcagagcactttctatctctttttcagaaaaatcccaaggaacaattgttttggattacttagtggactcagcatggaaactgcttgtgtggcccagctaggtaggggcgttcagacaaggagacctgacctggagcctctgggatgattccaagacagtcttgctctgtcaaccatgctggagtgcagtggtgcaatcttggcttctgcaagccttcgccttccaggttcaagcggttcttttgcctcagcttccggagtggctaggattacaggagacagattcctgaaattcaccccactgaaattgagtcagtaggttgggggcaagcctgggactctcgaagctcccccaggtgattctgatgatcagccagatttgggaacctttgatccagttcaccctcccacccagtgctccagcatccctgccgagaggttgactcagcttttccaagaagcattccctgacttgccttgccaaggtgggagctccacccaagtgcttcgaaaatgctgtgctcatcatcaaccccaatcttagtgtgaatcatgtattgtcatcgcctgtttaaatgtctcactcccccactagactctttgaagaaggggactgtgtcttagttaatgtattacccccaatacctgacttgtagtaaggacttcgtgtatttatcaagtgagtgagtgaataaatgaacaccactagaaatcta

SEQ ID NO: 49008 - DNA, 289 bp, Homo sapiens
ctttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacacgaacgtcagaaaacctcctttaattatg

SEQ ID NO: 49009 - DNA, 299 bp, Homo sapiens
tgggttgggtggcagcatcaacatcatagtaaaagagttgtctgtcatcggtgacttgcctgagtccagctaatagaaggcagggaaggtaggggtgaggggtacagaatctgtcatgtgtgagctgggaaggcagcccatcctggctgcctgctgctagcctctccatactccagcgtcgtaactaaacagtacttagtgtcttgcttctctgtataatggggatgtgcaaacctattttaaggtaccagaagcttaattgaaatagtacacataaagcatatgagacaaatacttgg

SEQ ID NO: 49010 - DNA, 524 bp, Homo sapiens
tgaggctctgattagccagccaactttctcttaagcctagtgagtttggggttccaagattatatttttctttcacattatattgagcgtttgctctgtgattgctgcctcaaaactagggtgcttcaaatgtaatttactcatctatcataaccagttttgcaggagtccctgacaagtgagtcgtagactctgaaaaggcaggatcaagacactgggtcttcttattgttgatttttgtttttctttttagaatcagggtctcactctgtcactcaggttggagtgcagttgcatgatcacagcctactacagccttgaactcctgggctcaggtgattctcccacctcagcctcctgagtagctaggactacagacatcacatccctggctagttggctaggtttttttcccccccgccagagatggagtcttactatgttgctcaggctcttattgttgaattttaacagctctttgtatattttggatataagtccttaactatgtatgtgatcggcaa

SEQ ID NO: 49011 - DNA, 634 bp, Homo sapiens
ctcttgactataaatgcgcatcatttgatgagatacattcagggaatctcagtatgtaacacaggtcatctgcgagtccctaaatttatgttacatctacctcctatctgtggtaaggacctacattgccatgccatacccagaaaggtgcctactgtaggaaatgcttaattgcatccccaagtggagcatttaggaggttatgtagcctatttgccaggactggccagaatctggtgtcctgagtttatatgtgccctggagttttctttgccccttgactgacaggctcatttaccaagacttcggtggcttcctgtgctggagtcattcatctttgctttgggtcccagtcctgcactgtagacagaatgtcgtggcctctatgatgatgtattcagttgtccttacctggaaggcacaagtctgattgggttttgaattccactcatgctatttctatggacatccacatccataaaacagagggcagtggtgtagtattaataaaatctgaggctgggtgcggtggctcatgcctgtaatcccagcatgggaggctgaggcggtggatcacttgaggtcaggagttcgaaaccagcctggtcaacatggcaaaaatctcatctctaat

SEQ ID NO: 49012 - DNA, 397 bp, Homo sapiens
ctcaacatgatttttttaatgtctaggtactctctctatttgttgaaaagcttattatttcacactttaaaaaaataaaatttatgtaaaacagaggaaataaatgaattctctgacatcttgtcacacagaaagacatcttttctgaaacactgttttcatgcaattattatacaaaccacctgtaacatgagatatggtgataactggaagtagcttaaataattcacaccctgtgctgttcgaaagaattctcgtctacccaagaacatgcagacttgtgctctaaaccaaacattgtcatgacaaccatattctctcaactgtaagacaaatatattttgcaagatatactatctttatgcaatgttataatctttaataaagaagcttacct

SEQ ID NO: 49013 - DNA, 291 bp, Homo sapiens
aaaagaggaagagagagtggcaatggtaccaagactagctttcattcttttcgttcttgccagggattacaatgtcacaagcctggggcaggatcttaattggaagtatgaagctaaggattatagaaaaacaggtgaactgaagaatattggagagtgtggccgatcttataagttcctctcaagaaatcaagactggaatacaaggtattcacaccctaacaggcctgctaagtactcaggaatagatgagatgtgcaaggcccaggagtctggactctcaccggtaag

SEQ ID NO: 49014 - DNA, 1443 bp, Homo sapiens
cttgccatgccccctcttcctctcatactttatcatctctgctgcctctccctccacctccatccttgctttcttctgagggtgggcaggtaggtctccctgctagatcaggctgctacatctccctggagtttttggccacctcctctcctgagctgccggtgttggggtgggtggcaggaaccgatagaacatccaaggtgaacatcggccaccctttccattagcaagggcctgcaccgggtatttggccagagttcctctgaattcacttggtctctggcagttgaccttgggttgaaaatgcagttttttgagtgggctttagagatcatgctgaggaagaaagaaaatagcgtgcacggatgtgttgctgtggttggatttcactggctgtttttcatatacctgtcttttccctgtgagagaaaacagccatgacagtaagcaggggaagctcatttgagagtaggggacgtggagggatgagggcagttctccggggcacccctgaaaatgaatttcctcctccagagccagggtgaccgggtccctcacagggccaccgtctgcaggcatcaacactcttttgggtctaaatccaattattcctcaagttcttcttggtggcttccttcactctctggccagggggagttttgcagaaatactgttctaacagcagagcatgtctgtgaccaaaccttgggcaaatacatatttaaagaaatcttattattaaaatagtcaaccttatggtttatgtagacaatctgataaacacagacaagggtaaagacagtacaaattgctccataatctcacaagctggaaattaccaacaccatttagtacttttgtgtatttcctcacagcctttttcattgcatatatgtaaatacactgtattttaaacatggttacaagcacattgaactttatatcatttttctttttcatttgacataacattatggcaaacaaaaactttaaaaaagcacatgggctttacaagtgagcatatgctttgcaaacatttctgtcagctaccagtaaccaactgcaaaaactcatattctacccaaaacagaaattgtgccagtcggggagtcctttgatcaccatgcagtaaacctcgccaaaatattgtaaatttaaacaaactaaaacccaaccacttgaaaaaatttaaagcacttaaattgctattggttcaaggaagaaataaagaatgtactgacaaatatttagaaagcattgaaaactagaatgccacatacccaaacctatgggagacagctggcactattctcatagccttaaatgcttttattattaaaaagggagagagaaaaggcaaataaactaagcattcagcctgagtgcttaggaaaaaaaaagaatataaagataaaggcagaaatcaatgaattaagaaacgga

SEQ ID NO: 49015 - DNA, 385 bp, Homo sapiens
aagggattaagtgctatatcaagaaagctggttacaaagaaagttattaatgtccattaggtgagcttaaaaagcacaagtctactgaagttcaaccagtcatcaaactgacaagtggcataaaactaaagctgaagttttgtttatgggtttgcaaaaccatctctaaatataacacactgccttgatttaaagcctctgtgtgcttacattcacaaaaagattatattgttcctacccagccctggaagaaaactgaagaggccattctatgaatgcttaagtccaaactttcttcttctggagaattttttttttttttaacagaagcttgctctgtagtccaggctggagtgcagtggcgcaatctcggttcactgcaacc

SEQ ID NO: 49016 - DNA, 434 bp, Homo sapiens
acctcactgtgctttaatttccaacttcatgtaaaataaataatacgctttgagtatttacagcaaatactcaaaaaatgttagatatttttcttagtgtgtgttattattgttcgtgcaataataagaatcataagacagaaggatgaagctgaagtagtgagacacataatgatgttaacaataaaaacaatttttgatacatttctcaaaactatctgatgggaaggatgtggtcaagtgaatccataccgatccatgttgaaaccatcaagcactgtgttgtgttgggattagatctaggagacactctatatttattcacccctcctttcttgttagtgctcagattgtcatacttgaccattaaaagtcttctaaatcatgggttttttttttttttcagaacttttgaaagaatcctgctcactgtc

SEQ ID NO: 49017 - DNA, 403 bp, Homo sapiens
ctagaaagataatccaagtagagatgtcaaataggctgttgaatttaaatcccaatgttataaatatggatgtgcccaaatgagctgagagaaaagtccacccagatcctaacagagggtttctctaagttgtcagagatttttattatcttttagtatagaattttatatttcctaaattttctataatgttgatgtgttatttttataatcaaatttaaatgttgctaacatatattcatcatagcattctttatactggtttaaaaatgggaaacaacctaaatgcataacaatgaggcaagactggttaaaagaaaatgggataggattgaaaacctttagccacctttaaaaaaatattttgagtgttactcaaaaaggaaaagttggttcagtttaa

SEQ ID NO: 49018 - DNA, 387 bp, Homo sapiens
ggagactgaggtcttctgagacagaaaaccaaccccatagcaggcctggtgtgtgccctagaatggcagaggccccacacgttgccccggctcctctggaagaccctccagcctgtctgctggattccttgtacttatgaggattgttaaaccatctcataggattcctttccagactcagcccttcacttgtggcagcatttcttactctgaggttctgggcctagaaacccagtgtccataggcaaggtctagggacagagagagtttgtagaaagtgggaatgcatcagtggaaggctaaatccaaacaggaactgagctggcctgggtggctttgtccttttgccatcttcgtaaccctttaaaggctttaagacacttcttt

SEQ ID NO: 49019 - DNA, 836 bp, Homo sapiens
  misc_feature (61)..(61): n is a, c, g, or t
  misc_feature (67)..(67): n is a, c, g, or t
  misc_feature (74)..(74): n is a, c, g, or t
  misc_feature (88)..(88): n is a, c, g, or t
  misc_feature (108)..(108): n is a, c, g, or t
  misc_feature (117)..(117): n is a, c, g, or t
  misc_feature (120)..(120): n is a, c, g, or t
  misc_feature (133)..(133): n is a, c, g, or t
  misc_feature (136)..(136): n is a, c, g, or t
  misc_feature (147)..(148): n is a, c, g, or t
  misc_feature (162)..(162): n is a, c, g, or t
  misc_feature (164)..(166): n is a, c, g, or t
  misc_feature (170)..(170): n is a, c, g, or t
  misc_feature (195)..(195): n is a, c, g, or t
  misc_feature (197)..(197): n is a, c, g, or t
  misc_feature (247)..(247): n is a, c, g, or t
  misc_feature (250)..(250): n is a, c, g, or t
  misc_feature (260)..(264): n is a, c, g, or t
  misc_feature (275)..(275): n is a, c, g, or t
  misc_feature (291)..(291): n is a, c, g, or t
  misc_feature (326)..(326): n is a, c, g, or t
  misc_feature (341)..(341): n is a, c, g, or t
  misc_feature (347)..(347): n is a, c, g, or t
  misc_feature (353)..(353): n is a, c, g, or t
  misc_feature (357)..(358): n is a, c, g, or t
  misc_feature (360)..(360): n is a, c, g, or t
  misc_feature (386)..(387): n is a, c, g, or t
  misc_feature (401)..(401): n is a, c, g, or t
  misc_feature (404)..(404): n is a, c, g, or t
  misc_feature (415)..(415): n is a, c, g, or t
  misc_feature (469)..(469): n is a, c, g, or t
  misc_feature (505)..(505): n is a, c, g, or t
  misc_feature (510)..(510): n is a, c, g, or t
  misc_feature (524)..(524): n is a, c, g, or t
  misc_feature (665)..(665): n is a, c, g, or t
  misc_feature (690)..(690): n is a, c, g, or t
  misc_feature (709)..(709): n is a, c, g, or t
  misc_feature (746)..(746): n is a, c, g, or t
  misc_feature (751)..(751): n is a, c, g, or t
  misc_feature (780)..(780): n is a, c, g, or t
ctcttattgaagatatgtctgcccaataaacaaaacatcagcagaactatcatatactggncaaaanatcaggntgataacaaaagcnacatgcaacataaaatatanacaatatanagntagacaatctgcnganttttaaaaacnntctaattttcattncnnngccnccagcacagaacgaatcggccaccncnccccaaccccaccaaggccaagcccggccgacgccggccaggcgccaacnccnggggaaaaannnnngcagcgcaagngagcgggggggggggngggggggggcggggggggggacaagcgggaggagngaaggggggggggangggagngagagngatnnanaggggaggggacaggggggggggagnnaacggggggagggnggngaaagggatgngggaagggggggggggggagggggaaaacagtagggggggggggcgcaaaaaanactcaaaacaattgagttaaaggttgcacaagagcnatgtncaggcatttacgcntatgggaagtaaaattaaaagaggatacttttttcccaaggagaatttctttaaaaccaagcacattgctaaatagcaacattatactcggtaaacaataattggcaacaaaataagtttaatattctgcccaaaccagtnccagatactgtttaataaccaaganacaaactaattttgttgtnacaagcctagaccaattttatcaaacatgtccttggntaganatccaatttcatttaacgttttgaaagcncatttgacagccagtaaagtgcttcatacagaccagttccttgtgttgcacaagtt

SEQ ID NO: 49020 - DNA, 850 bp, Homo sapiens
atttcttccactctctctttactctttttcctcctttactctctctattccctgaggcttcattgaaagatgatatagaattaacttttccaagatatatttgtttttaaaagggatttttatcaacaaaaataaaactcgaatttagaataataatctgtaccctacttctgggaagttaccagtggtggtctggcaaaaaacaaaaatactggtagacttaggataggggaggtggtttagcaagaaggtggcacaggaatatttttaaaatttaaccctgtattatttttacattttaaggcccccatccagttctgtttaacagtcctttttaccaaggcatcatttttatttgacgtgttaaacaaagaaaagttattctagctttggcatcctttaaaataaatagaattttggctttacctttgatctgcctttgagtgtgatgttatatgaagatagtaactcactatgaaaagattagttttgtctttgttctgaaaagacattcctgaagtaattcatattccttaaaatttgccactttgtataacatattcatgtcagaaattgcttttttcctttttagcgtggttctgaaatcttggatataaagcttctctgagttagataagctggaacaactgatacctcagtatcagttgttactgattacagtacattaaatacaaaaattagacaggcatggtggtgcatccttgtaatcccaacttcttgggaggctgaggcacaagaattgcttgaacctgggaggtagaggttgcaatgagccaagatcacaccactgcattccagcctcggtgacagagcaagactttgtcaaaaa

SEQ ID NO: 49021 - DNA, 340 bp, Homo sapiens
atcgtgccactgcactccagcctgggtgacagagggagactcagtctcaagaaaaaaaaaaaaaaattactatagcagtttccccctcctaagtgtagttttcctttctgagctaaccattgttttcatcgttccaatacactacattccaaaacttaaaacatacaagaacaggatatctcagaagaaccctgagaattgaagtcctttctatcttcaatctataaggactggctactccacatcaggccttgaattagggtttaccctaatgttgataacttttaaaaattcttaaatccttcatcttgaacttactattaggctaaatcttctctct

SEQ ID NO: 49022 - DNA, 1125 bp, Homo sapiens
gaaaggggaacttcagatgccggccagaaacctgagcaagaagtgacaatctgacctctaagagaagtataggaaagccctgcctaccagctataagaactcaaactggggcagaatggaaccatggcatagggtagggctgattgtccagacatgtttgtagctcccaagggcacacatagtgctgttggcagcttagtgagatttaatgctacatagtgcctataccaggcatcaggccaaggttgggaatacataattaaccgggatcattaagaaaaatttagaatatatttattatagattacaagatcagggaagtatcttttcacttagttaaaactaaatatacccgcaatagaaacagctctttaaaaaaaaaaaaaaaaaacctaaaaaagtcacttaaacggaacctgagtgattgggacatcactgtttatagttttccatttccttcacatgaagtttttaatgcacttgggcaggcttttcagtctaattcctctgttcctatttttttcttatccatcataatgattgttgaagatttccaataatgtattgaaaattgaactcctttgatagcatatacacacatgtatgtatacatgcacacacctttctgctgggtacaagtcatcattggagcagacttgcctgttacctccactctgttccccttctcggcatgctcttagacgctctttacgcaggctggtggagagaaatctttctaaatacctttggctcactttcttggacatccttaccatctcattagtcagacaaacatttgtcagacgtggtttatatctgtaaggcatggtggggaaagaatgagaagtgtaagtcatggcctctgcactctaggagtttatcatttcaggatggggaggtaaactagtgtttgcttgctgtgtgtcaggcactgttccaagctttttttttggctgcaccatctcctttgaccctacagtagccctcagtagctgccatttttttctaacttcgtaacgatgaagacatcgagacttggagaagataaccaacatcgtctgtgcttaggaagtgacagcatttgtgggtgaagctgggattctcctaatgccctctctgcctttg

SEQ ID NO: 49023 - DNA, 1280 bp, Homo sapiens
gtgaacctcagagctccatggagggggctccaggtggctggagctggcatccttgagggagcaccatgtgggggtgctgcaggaatcagtaaaactgcaaactcggttctttcactgctgagggagggaactgctactgcctgggtgaagcagtgggccacggtgctgctcatagaaacaagaaacagaccggaaggagtgtgtctggcctctggcccctcctggcagagcttcttgaagagcagttggcaaagcagaaatggggcttgcagagtcccccaacatctgaatgtgggggatttggagatgacaagcaataactaataaccggcccagcctctcacgagcagagggctggatatgtcagtcctgtgtctgatcactgggtcatgagagcagggactctctaaggttttcccagccctgatgttctacaagattggaattttctacatcaaaatttctaggtggcctccaaggtggaggaaaggaagaaaacagcaggctaaggggagagtgtgaaggaagagtcatcatttcactcaaaccccacagagcagccaggtgcttggtgctgtgaaggtctcctgccagagcagaaggcaagcaacctctctaacaaatctctttcctgggctacggctgtttgtttgtattaaaacgggaacatgataacagagctattagtagctccatgctcagctgtgcaaggtagggagttagagcactgaattcagtcactggagaaagaagctgaggtctcctgatggccctaggatgagggctgggctatctgtgaatagcaatgggcttaggtcgctgggtttgtcaagcagccacgggagctgctgggtcaggtgaacctgagctccccctcgatgagcaaacacaacttggaccatgtcctccactgacgcagaacccgactgcccgagccctctgtggctggggagcaatgccatggcagaaaacgcagttctgatctgagcttgctggtctggtctggagaagcaattcagagcctgtagggccctggtcgagatgagagaaggcaagcctgtgtgaagccagttctggttccagccttggaactggaagactgtgggatgttgggtaaatcatttccaacctctaggcctcagcttcctcatctgtaaaaagaggctttggagagggtggtcttcaagtttcttccagcactaacaatctaaattattctatgtaggagaaaaatcagaatttattaaacttataaaacagatacatttctatcatgctgc

SEQ ID NO: 49024 - DNA, 118 bp, Homo sapiens
taaatctgttgtgttgaatgccaagaggcttggggtgctctggaaggacagagcccgacacagtaaaagtccaagaaatattttataaattagtgaatgatgaaaaggttttcttttt

SEQ ID NO: 49025 - DNA, 346 bp, Homo sapiens
tgtgactgtcactcaggctgaaatgaaatgcagtggtgctatctcggctcactgcagcctcaacctcctgggctcaagcacaatcctcctacctcggcctcctgactagctaggactacaggtgtgcaccaccatgcccagctaatttgtgtttattttttgtagaggtgaggtctcactatgttgcccaggctagtctcaaactcctgaactcaagggatctacccccctcagcttcccaaatttctgagaaagtgtaaccaaggcctcccctcagaagtctccctggagaagcttcagttggagtgaggtggttgggggtggagatgggggcagagtttcttat

SEQ ID NO: 49026 - DNA, 321 bp, Homo sapiens
caacaacaacaacaaaaaagcacctgtaattccaccagcacttgctttaatctttgcttttcacagccaagctatttgaaagcctacttttgtctctctattcttactttctatttacaattatattttaaatgggggaaggtatagggacatgaagggagataagtttacttcacttgagttggtaaaattatgacaccgggaaattgtgatacagacacacacacacatacacacaataatgtatacctagagcagccactatagaagctgtaaaaagagataactcaaaaacaccatagataaattaaaatgaaattc

SEQ ID NO: 49027 - DNA, 1115 bp, Homo sapiens
actgtgattataagccattttaaagtaagacatttgctatttcacaccaacaagtttttataaaatacatttctatttgtatgtatttaaactgaatatccccccttatgagggggatgtgttctaagatccctagtgggtgcctgaaactgcaggggttttttctcctgtacatacatacataataaagtttataagttaggcacagtaagagattaatgacaataactaataataaaatagaaaattctaacaacatacagttcaacaatttcacaaatagaagattcattcttacagatcttagcaatctcagcatactatttttttccttgttaattccagagctttcacctattaacttaaaaggaagcattttatgacgtcttttcgacatatctgaagtgccagcatcactactcatgagctttgggggccattattcagtaaaataaaagttaccttgaacacaatcattgcaatactgcaggtcaatcttctactaagtgactaacgagcaggcagcatatagagcccagagacagaagatgcacaggccacatgggatggagcaggacagtgtgagatttcatcacgctactcagaggcggcaacgtaaaagttattgtttatttccaaaattttccatacaatatattcaaatggtggttgaccatgggtaactgaatctccagaaagggaaatcttttataagaggagccattatgattatttgtgtatttgtgtatgtgtgtttatgtttttagtttgattcttccactatctctgatttcttattacccatggcttataagaaacaccaatctcctgtatttcagcgtatctcctatatccatgcctaaaaagcaagtaatatttgaataaaagatgtattgcttttacttaaaagaatgatttcccctcctattttgctatattagaagagaatattaaaagtattaagcttaataaaaataagctatatatataattatgggacatttacaatttagaaataactaacatactttttaaactctacaattacatttttcacctctgcttttgctaaaaccagacaagattatattcaagtggccattcacattttattg

SEQ ID NO: 49028 - DNA, 680 bp, Homo sapiens
atattatgcaactttcagtattagtactctcagcaagttggactgttactacatcatagttattgttgctgtaaatattctgtggtaggtaatacactgatactgtgtttttgccaagaagtatagtttttcatttatcagctgatttgtcactgaaagcatgtgcaccatacccataaatactggatgaagtttttcagcccttactatgacccatatttcttttgcacactgattgtctttctccttaagatttgcggaacagctctctgagctcggacgtagttcacagcaacgtggctaaaccaagaagttggaatcgttggtaaatacaggacccgctatggggtctccctccagaaaatggtgaagaaaattgaaatcagccagtacgccaagtacatttgctcttttctgtggcaaaaccaagatgaagagacgagctgtggggatctggtgctgtggttctgcatgaagacagtaacggtgtcttcatccaggaaccacattgtctggacctacaataccacttcagctgtcacggtaaagtccaccatcagaagactgaagcaattgaaagaccagtagacgctcctctactctttgagacatcactagcctataataaatgggttaatttatgtaaccaaaaaaattaaaaaggtttgtggaaaaactga

SEQ ID NO: 49029 - DNA, 689 bp, Homo sapiens
cgcgggggctcccgctgcagcgacatgggcggctcggcgcggctgacctcgcgctgggggagcggcttctcccgcgacgggggctgcgcgtccgagcggggggcaggctcccgcggggccggcggctccgcccgggccggctcgcggtacggctgcggctccagccgggggggctcgcgggggtactcgggctcacgctcgggccccgggtactcggcctcgcgccgccgcaccggtgacaagctaatgaacgctactctgcgcggctccgccatccccactgttctggccctccgcttttgctcgagccggcgctcgcttctacggcgcgctgcgtgcctgcccgcccttcctcttgctctctgtcgcttttcttccctccaccaccctcagccgtctccgccggcgccacgtgatggatgctcggcttgcctccaactacccaccccccaccccaccaccaccacagtgcaactatggacatcctcagtcatgtgctctttgagtctatatgagaatttatttcggacacagacccaggcaagaaccgttggatctttaggcctgcgtacacattaagagactattctccaaaatggtcacaccagtggtgtgagggttgctgtattacctcctcttctcccatcgcattgccaccaataaatacagtttaatttctgcaaaaacat

SEQ ID NO: 49030 - DNA, 841 bp, Homo sapiens
cgcgggggctcccgctgcagcgacatgggcggctcggcgcggctgacctcgcgctgggggagcggcttctcccgcgacgggggctgcgcgtccgagcggggggcaggctcccgcggggccggcggctccgcccgggccggctcgcggtacggctgcggctccagccgggggggctcgcgggggtactcgggctcacgctcgggccccgggtactcggcctcgcgccgccgcaccggtgacaagctaatgaacgctactctgcgcggctccgccatccccactgttctggccctccgcttttgctcgagccggcgctcgcttctacggcgcgctgcgtgcctgcccgcccttcctcttgctctctgtcgcttttcttccctccaccaccctcagccgtctccgccggcgccacgatttgcggaacagctctctgagctcggacgtagttcacagcaacgtggctaaaccaagaagttggaatcgttggtaaatacaggacccgctatggggtctccctccagaaaatggtgaagaaaattgaaatcagccagtacgccaagtacatttgctcttttctgtggcaaaaccaagatgaagagacgagctgtggggatctggtgctgtggttctgcatgaagacagtaacggtgtcttcatccaggaaccacattgtctggacctacaataccacttcagctgtcacggtaaagtccaccatcagaagactgaagcaattgaaagaccagtagacgctcctctactctttgagacatcactagcctataataaatgggttaatttatgtaaccaaaaaaattaaaaaggtttgtggaaaaactga

SEQ ID NO: 49031 - DNA, 468 bp, Homo sapiens
cgcgggggctcccgctgcagcgacatgggcggctcggcgcggctgacctcgcgctgggggagcggcttctcccgcgacgggggctgcgcgtccgagcggggggcaggctcccgcggggccggcggctccgcccgggccggctcgcggtacggctgcggctccagccgggggggctcgcgggggtactcgggctcacgctcgggccccgggtactcggcctcgcgccgccgcaccggtgacaagctaatgaacgctactctgcgcggctccgccatccccactgttctggccctccgcttttgctcgagccggcgctcgcttctacggcgcgctgcgtgcctgcccgcccttcctcttgctctctgtcgcttttcttccctccaccaccctcagccgtctccgccggcgccacggtgagtgcggaccgtgtccccttccccgctactacgttctgatgggcttcaccgc

SEQ ID NO: 49032 - DNA, 488 bp, Homo sapiens
taacagcagacttccagttaaacttcgtgattgaacacatgtttttccatgttccttcctagtaagggactaaaaattttgagcaaaagactaaaaaatatataaatccacaggcataaggaagaggaagcaacatattaaagagacacaacttttggaagatgtaaaggaggaactggcagaaatgggaaagccgaatacatgtgactggagagtgttgtgtcaatgagaaacaagacagttcatactccagaacctgtttaagaattagaggcagtatgtcctgtagaaaacagtagctgaagtagaaataaagtataattaatatactcagagagatagcagaagatactgctactatgaaacatgacaagattatataaaaagaagaaataaccagagaataagcacttttataataactgaaataagcttttatatgatagaaattttcctgaaaatagagcaaaaaaaagtcaaataaatgg

SEQ ID NO: 49033 - DNA, 632 bp, Homo sapiens
  misc_feature (1)..(1): n is a, c, g, or t
  misc_feature (152)..(152): n is a, c, g, or t
  misc_feature (323)..(323): n is a, c, g, or t
  misc_feature (331)..(331): n is a, c, g, or t
  misc_feature (337)..(337): n is a, c, g, or t
  misc_feature (470)..(470): n is a, c, g, or t
  misc_feature (564)..(564): n is a, c, g, or t
nccgggtggcaggaggaagtcagcctggaattaaaatgtttggggactaagacaaattcagacaactgggaggtgagtcaagatggggcaaccatgtaatttatcacacaaatcaggtcacatttcagactgaaagggagagcttgtaatantaatatttacaccaagacaacaggcataatccagactgccctgggcacctgagtgtagataaatatccagctccacacttaggtggacaagggcagaggcaagaactagaaaagaggtgtccaacttccccagtagggccacagcctgacttgtccaccctcttcttcctngataaagntagtancaatacagattttctgttgcatagattagaatatgaggcaaaaatgaatagggtggctggagaaccagaattagggtcccctgggtggagggagttgtggccatgaaggaggaaagccacacgggggaaccanccccaggagaaaggacaaaggaccaagaggttgcagtcagcaagcgtggccctaagggagcaagtgggcactaagtatatgtaaaggtttgcangtggtaagcatttacagggaggggggtgtgttatgtgtttatatattatgtgtgtacattagtttcct

SEQ ID NO: 49034 - DNA, 348 bp, Homo sapiens
aaaatctataacattttataagtaactacattatcaaattccttagagaacagaaacttttctacttccatttctcaagaggaaagaaaacttgagtacagacttgaaaaatgagtctataaaatgagtatgatcttagagcagaatctttgaagtggtcccaggtcccagtgacaatagatttccaatgtctattacttcagtatttagaaaatagatgacaagttttgaggctttatttagtatatttaaaattaaaagaattgattaatacattatattagagaataggaatttttatagtcatcagttaaatggtatacttttggaaagcgttcataatgatat

SEQ ID NO: 49035 - DNA, 315 bp, Homo sapiens
tcggcacgaggaaattagaccaggggtcagaacatagattttagtctcctttagttcatctactaggagactaaattagataatctctaaactcccttttagttctaaaattctgtaattaaactctagcatatcatcattttagactaaaagttttcttcttcttcttctttttttttttgtttttttgagatgaccgaactcgttcatgtttgtttgcaagaactgcagttgaaccttgtttgaggcgattcataaaattgatctactcttatactttaagttttaactgtgcacctttttgctaactctgtc

SEQ ID NO: 49036 - DNA, 612 bp, Homo sapiens
aaaagagttccctaagtaagctcctactgggtgtcctccactcacatggagacagggccctgccttttaggcacttactcttccagtgtctattgcataatatgttcaggaaggatcccagattcaaagatttatagaattagagttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcct

SEQ ID NO: 49037 - DNA, 329 bp, Homo sapiens
agtgctcaagcatagatgaagcagaattagaaatgcagctaggatcctggaggtatacgtctgtgctaggtgttaacccttcagttgctggtttgtgaataggaggtcccaagggatcccaggggaagggagtggtcaggaggtttgggacagcagctatttaccaggtagtactagagtatttcagtattttaatagtcaatgttataactgataacagtcaattgatacatataagcctaatattagtccttgctatagtctttattatcaatagcctccgcccttccctttctaaagccgttgctatctggcctgtccctaggaga

SEQ ID NO: 49038 - DNA, 1160 bp, Homo sapiens
agagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcagtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgttcgtaataaatcatgtgccacatcttgtcttacacataaaagccactgcttttaacatcccattgtacatttaacacataaatggtgttaacatcccattgtacatttaacacataaatggccattgtctttgtctcagtaaagtgtaggtggacaatcttcctgtgatatgtagtgacattggtcatgtagctagataattatggtaattgtgacaattaaagagaaataaattattgattatccttcagaaaaa

SEQ ID NO: 49039 - DNA, 1304 bp, Homo sapiens
agagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcagtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgttcgtaataaatcatgtgccacatcttgtcttacacataaaagccactgcttttaacatcccattgtacatttaacacataaatggtgttaacatcccattgtacatttaacacataaatggccattgtctttgtctcagtaaagtgtaggtggacaatcttcctgtgatatgtagtgacattggtcatgtagctagataattatggtaattgtgacaattaaagagaaataaattattgattatccttcagaaaaaaacacacaggatagaggatggtacagttttcttacttcaaccaagtaattctcaaagcatccagctatttccatttggctgttactttttgcacatagcttgcatctgtttgagacttaccatgtacatcaacccaggtctgtg

SEQ ID NO: 49040 - DNA, 294 bp, Homo sapiens
aagctaagatttgagttgcttgggtggagtaggtacaagttggtgattaccattcaggttggctgccatctgggtaggtctcccttcatggaaggccccagcagggaagctgtaatcatgtgctcagtgaaggcaaaagtcgttttgatatctttttagtaaatcattccaccaacgctgtgcaagccataaatgtggcacagattaattgagcaaaaaaagtgacttgcatacagttggcacttctgttcttattaggatcagaaagaacaattgggtgaagatcacttcagg

SEQ ID NO: 49041 - DNA, 724 bp, Homo sapiens
  misc_feature (717)..(718): n is a, c, g, or t
  misc_feature (720)..(722): n is a, c, g, or t
  misc_feature (724)..(724): n is a, c, g, or t
cttacattcactttgccacctgtaggccacaccccatccagctcccagcatcttcatcttaaaacagatcagatcatgtcactcttctctttaaacgcttctacggcctgtgcatttcccttcagatattatccaaactcatcgtcgtgaccttcaaaaccttgtggtctggcctctgttggcctccctgacctcccctcccaattctttctctgcccccggactccagtatcacagtctgtctctcagccacaatttattttgcccctagagtttgctgtgcttataacacttctttttcccatatgtcattcatttctcaagtctaagagtagcagttaccatcttagacgaccgttcccttacccctcccttagtcttgggttaagtcccagaatccttgaatttgccgttcctgatacataaatatgtaatttcttgtgtggcctgagactctctctctaaactaagggctttacaaaagcagagaccacatcattaactcagcacttaacccagagcctcacacacagcaggcaatcaataaatatttgttgactgatcaaatgttttggtgccagtgaagagttgggcttgctgctgctgtcttcagcgtaagtcttgctttttcagctgggtttctaattgagaatttagagagtgcattggtgaggattcttttgactgcaagtaacaaaataaaatggtggcaagaannannnan

SEQ ID NO: 49042 - DNA, 565 bp, Homo sapiens
cttacattcactttgccacctgtaggccacaccccatccagctcccagcatcttcatcttaaaacagatcagatcatgtcactcttctctttaaacgcttctacggcctgtgcatttcccttcagatattatccaaactcatcgtcgtgaccttcaaaaccttgtggtctggcctctgttggcctccctgacctcccctcccaattctttctctgcccccggactccagtatcacagtctgtctctcagccacaatttattttgcccctagagtttgctgtgcttataacacttctttttcccatatgtcattcatttctcaagtctaagagtagcagttaccatcttagacgaccgttcccttacccctcccttagtcttgggttaagtcccagaatccttgaatttgccgttcctgatacataaatatgtaatttcttgtgtggcctgagactctctctctaaactaagggctttacaaaagcagagaccacatcattaactcagcacttaacccagagcctcacacacagcaggcaatcaataaatatttgttgactgatca

SEQ ID NO: 49043 - DNA, 333 bp, Homo sapiens
gaaaaggatctttttcatacctgtcttctcctatgttttattcataacacatcctgtttttgtcggagagttatcagacttatggtgattaggcaccctctgcttatttggagatagagatttttgagggcaggtttaaagtttcactttcaggtaattagccattctcttaactggtctgttgctgtggttgggagatgagtatagtttgctcttttaggctgggcgcagtggctcacatctgtaatgtcatcactttgggaggccgaggtgggagaattgcttgagctcaggagtttgagacctgcctggacaacatagcaagaccttgtc

SEQ ID NO: 49044 - DNA, 704 bp, Homo sapiens
atgacgatcagcttgatggacatggccaaccaggttaacagctgaagggtcactagagaggtaacctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaaaaaagt

SEQ ID NO: 49045 - DNA, 1937 bp, Homo sapiens
acgctgcgggtccggtttccggcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaaaaaagt

SEQ ID NO: 49046 - DNA, 1740 bp, Homo sapiens
acgctgcgggtccggtttccggcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatggccaaccagggttaacagctgaagggttactagagaggtaatctgagaaaaaatatttgctgttggagcaactctgctgtcctgatgttcctcattttcactttggg

SEQ ID NO: 49047 - DNA, 2158 bp, Homo sapiens
  misc_feature (10)..(11): n is a, c, g, or t
  misc_feature (22)..(22): n is a, c, g, or t
tatggcgggnnttcttaggggntacacccccaaatttttaaaaaaaaaaacccccttttcggggccggtaaggcgcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagggactcagacaggcacttagaatatgctgcctttaaaagtcatggatggtacaaatgccgtaagcaagacactattcataacagagatgttgtggacttttgttcttaaaggacagtaaaggagtgagagagaagtgagttagcaaatgctggtgaaactgtccccaactcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaaaaaagt

SEQ ID NO: 49048 - DNA, 1803 bp, Homo sapiens
catagctgatctccaggaggatccccagcgtactcacagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaaaaaagt

SEQ ID NO: 49049 - DNA, 1990 bp, Homo sapiens
  misc_feature (10)..(11): n is a, c, g, or t
  misc_feature (22)..(22): n is a, c, g, or t
tatggcgggnnttcttaggggntacacccccaaatttttaaaaaaaaaaacccccttttcggggccggtaaggcgcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaaaaaagt

SEQ ID NO: 49050 - DNA, 1289 bp, Homo sapiens
acgctgcgggtccggtttccggcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggtatcagaggaagtattgagacagttaccggagatacttcttcagctaattatcaagatactaaagttaatactaaagagcattcagtcaggaaatagtgttataaaagagaatttacttttcaagctataatgctattttgattaatgatttttctttaactgaagctctaatttaatgggaggaaataaaagtttgaataccagctttctattttctaaatattggattatatcatgaaaatcaagcagtttctatttctttaaatgcttttattaaagcaatctaattatgtg

SEQ ID NO: 49051 - DNA, 1015 bp, Homo sapiens
acgctgcgggtccggtttccggcgggagcgtgggccgccagactcgggagaggctgcgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaaggatcaattacaaggatggcgccagttcagagctggacagggatttgcctggcagatgtcctcatggaggtatttt

SEQ ID NO: 49052 - DNA, 813 bp, Homo sapiens
gtttaatttcagctgcagagggtgttgtgaggaagctggaaaggaaggttggattagagaagcctcgagctccaggtaagcgatttggacatgcccacctttcaagaggggctgcaggcacccacaggcacaagctgaaggcagcagcttggctggcttaatactgagcaggtggtggggtaaatgcctgcccccctccctctggcctctgggccctttgcagtaatcacccagggtctggtaaagccactgagagccctactggcacctcagaatcacagtgttattgatcagggatgtgaggctgctgttgggggttgggggaggcaaatgggcaggcagttttgagaagaaccttctaataagaaatgtgagggaggttacagcagtgtgtgagaaagaccaggaagaaggagacaagtttgggggctgcttcccctaatgggatgatgcaatctgggctcatgctgccaactaattcttccacatgaaaaaaaaaaagttttttggcgggcacggtggttcacacctgtaatcccagcactttgggaggctgaggtaggtggatggcctgaggccaggagtttgagaccagcctggccaacatggtgaaacctcatctctactaaaaatacaaaaaatgagccaggtgtggtggcgcatgcctgaaatcccagctacttgggaggctgaggcggcagaattgcttgaacccgggagacagaggttgcagtgagccaagatcacaccactacactccaacctgggctacagtgagactctgtctcaaaaaaaaaaaaaaaaaaaggccgg

SEQ ID NO: 49053 - DNA, 717 bp, Homo sapiens
gtttaatttcagctgcagagggtgttgtgaggaagctggaaaggaaggttggattagagaagcctcgagctccaggtaagcgatttggacatgccccccctccctctggcctctgggccctttgcagtaatcacccagggtctggtaaagccactgagagccctactggcacctcagaatcacagtgttattgatcagggatgtgaggctgctgttgggggttgggggaggcaaatgggcaggcagttttgagaagaaccttctaataagaaatgtgagggaggttacagcagtgtgtgagaaagaccaggaagaaggagacaagtttgggggctgcttcccctaatgggatgatgcaatctgggctcatgctgccaactaattcttccacatgaaaaaaaaaaagttttttggcgggcacggtggttcacacctgtaatcccagcactttgggaggctgaggtaggtggatggcctgaggccaggagtttgagaccagcctggccaacatggtgaaacctcatctctactaaaaatacaaaaaatgagccaggtgtggtggcgcatgcctgaaatcccagctacttgggaggctgaggcggcagaattgcttgaacccgggagacagaggttgcagtgagccaagatcacaccactacactccaacctgggctacagtgagactctgtctcaaaaaaaaaaaaaaaaaaaggccgg

SEQ ID NO: 49054 - DNA, 837 bp, Homo sapiens
agaacattcagataatagtagatgctgaacttcctgtactatctttctttggctagattccactgtcttctgtgtttctgctacaagacttcttttagactctaccccaccttgctagagtcttggcttagcttctgttcttttttagagaagaaacttagggctttcctcattcctcatattctaagtgctccaacctgaataaccatctctctctctgggattgctctctggtctgggtctgccaccgcctttgcttgaactttagtatctttgactatgagttcttgcctcctttagtctggttcttccagtcttgattgtaactcacgtcatacctttaaccccccacctttaagtttaaaaaaatccttattttctgctctccaaaatataagatattctaatactaatttcagtgaaagacatagttggctactctacctttttccctgcccttgctgcttattttgctgacttatgatcactgcttgtctaaggagaaacctattgtctaatgctgattaggaaatggcatgatgtttggttgtcttacctctctgaaaataatgtttacagaccatgtggcaaaggaataaaaattacctgtggctcaaaagagagtggattgcaaaaacagccaataattcgcaaataatttgatttttcagatgtgtctttatgaatcattgatcatatgtttgacttgataattgttatgtattttagattttattctgatgaattataatacgtttaagtaaaaaggcaaatagttaaattcattcaacaaatattgcatacccactatgtgcgggatactgaattaggtgatac

SEQ ID NO: 49055 - DNA, 307 bp, Homo sapiens
ttctcaagatattttattttgaaaggtgtaacttttatctcattaaatatttgaaatttaaaaattgtcataatctaaaatatcatacctgaaattaagttaaagagaatacccaatatgcttgaaattatgtaaacctatatagttagtaatatctgctgtgagcaggtaagaactaggatattcttttcttttttattgttatattttggcaaagtatatttcatgtcatgatccattaaataagaatattgagtatttctgaaaaagtaaaatgttggtttgtggtatttcaccttatttttaa

SEQ ID NO: 49056 - DNA, 247 bp, Homo sapiens
ggaggttgcagtgagccgagatcgcgccattgcactccagcctggacaacagagcaagactgtctaaacaaaagctcaacaaactacctgccatccccaaaactaatctcacctcctaaagcattaacgacccttcctgaccaaatctaaactagcgcccagattttcttcccatatggctcagcccagctccgctgccccacaggtgtcctgtcaggatccgcttcacatttataatacctagcac

SEQ ID NO: 49057 - DNA, 3061 bp, Homo sapiens
  misc_feature (10)..(10): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggcgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgca

SEQ ID NO: 49058 - DNA, 448 bp, Homo sapiens
tgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgca

SEQ ID NO: 49059 - DNA, 401 bp, Homo sapiens
  misc_feature (175)..(175): n is a, c, g, or t
  misc_feature (310)..(311): n is a, c, g, or t
  misc_feature (314)..(314): n is a, c, g, or t
  misc_feature (316)..(316): n is a, c, g, or t
  misc_feature (319)..(319): n is a, c, g, or t
  misc_feature (322)..(324): n is a, c, g, or t
gatgctgtcacaagactcaaagtcttcggggaatttgccgacttggaaggcatccatgggcaccctggtgaggccagtgttgtcacagatgacccgagacagggagtgcttctccagctcacgcctctgtgcatccgtgaagacgtggctgttctcccaccaaaaccagtcaccntcccgcagagccttcatctgcttcccaatgagacaggcaaacaggggccctgtccgagccctggggaggaagttttcagctaagcctcccagccagacatcgatgttgtcaggatgcttgtacaagtccaggtcnnggnangcnccnnntggcgatggctgtgctcagtcagcggggtctcaggcgaggcagcaccagactccctccactcagggatcctctagga

SEQ ID NO: 49060 - DNA, 3910 bp, Homo sapiens
  misc_feature (10)..(10): n is a, c, g, or t
  misc_feature (3740)..(3740): n is a, c, g, or t
  misc_feature (3789)..(3790): n is a, c, g, or t
  misc_feature (3823)..(3824): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggcgacttggatctccatgtcgctggctgctctgctgatcggaggcttcgcaggtctcacctcgacggtgatttgcaggtggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcanaggagggctatgaacattttgcttcaggatgttttatttcgctctactnntatgtagagaaagcatggtttgctttttataanntttgtgacccaaaaataccagactgttgttttccctaggtgccaggccatcctgttctgtgtgttcccaaactctttagttttgtt

SEQ ID NO: 49061 - DNA, 2259 bp, Homo sapiens
  misc_feature (2089)..(2089): n is a, c, g, or t
  misc_feature (2138)..(2139): n is a, c, g, or t
  misc_feature (2172)..(2173): n is a, c, g, or t
ttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcanaggagggctatgaacattttgcttcaggatgttttatttcgctctactnntatgtagagaaagcatggtttgctttttataanntttgtgacccaaaaataccagactgttgttttccctaggtgccaggccatcctgttctgtgtgttcccaaactctttagttttgtt

SEQ ID NO: 49062 - DNA, 1248 bp, Homo sapiens
  misc_feature (10)..(10): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagccttttactgggttcttgctcgtgctgggtgctgcgtgcaatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtgg

SEQ ID NO: 49063 - DNA, 1755 bp, Homo sapiens
  misc_feature (10)..(10): n is a, c, g, or t
  misc_feature (1529)..(1529): n is a, c, g, or t
  misc_feature (1664)..(1665): n is a, c, g, or t
  misc_feature (1668)..(1668): n is a, c, g, or t
  misc_feature (1670)..(1670): n is a, c, g, or t
  misc_feature (1673)..(1673): n is a, c, g, or t
  misc_feature (1676)..(1678): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccagtcaccntcccgcagagccttcatctgcttcccaatgagacaggcaaacaggggccctgtccgagccctggggaggaagttttcagctaagcctcccagccagacatcgatgttgtcaggatgcttgtacaagtccaggtcnnggnangcnccnnntggcgatggctgtgctcagtcagcggggtctcaggcgaggcagcaccagactccctccactcagggatcctctagga

SEQ ID NO: 49064 - DNA, 2890 bp, Homo sapiens
  misc_feature (10)..(10): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggcgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgca

SEQ ID NO: 49065 - DNA, 4040 bp, Homo sapiens
  misc_feature (10)..(10): n is a, c, g, or t
  misc_feature (3870)..(3870): n is a, c, g, or t
  misc_feature (3919)..(3920): n is a, c, g, or t
  misc_feature (3953)..(3954): n is a, c, g, or t
gaggcaattnaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggcgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcanaggagggctatgaacattttgcttcaggatgttttatttcgctctactnntatgtagagaaagcatggtttgctttttataanntttgtgacccaaaaataccagactgttgttttccctaggtgccaggccatcctgttctgtgtgttcccaaactctttagttttgtt

SEQ ID NO: 49066 - DNA, 1794 bp, Homo sapiens
  misc_feature (1624)..(1624): n is a, c, g, or t
  misc_feature (1673)..(1674): n is a, c, g, or t
  misc_feature (1707)..(1708): n is a, c, g, or t
tggttttcttttctcgtagtttgactacatgtcaacctgtccacatttcatagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggcgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcanaggagggctatgaacattttgcttcaggatgttttatttcgctctactnntatgtagagaaagcatggtttgctttttataanntttgtgacccaaaaataccagactgttgttttccctaggtgccaggccatcctgttctgtgtgttcccaaactctttagttttgtt

SEQ ID NO: 49067 - DNA, 1427 bp, Homo sapiens
  misc_feature (1257)..(1257): n is a, c, g, or t
  misc_feature (1306)..(1307): n is a, c, g, or t
  misc_feature (1340)..(1341): n is a, c, g, or t
tgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcanaggagggctatgaacattttgcttcaggatgttttatttcgctctactnntatgtagagaaagcatggtttgctttttataanntttgtgacccaaaaataccagactgttgttttccctaggtgccaggccatcctgttctgtgtgttcccaaactctttagttttgtt

SEQ ID NO: 49068 - DNA, 1059 bp, Homo sapiens
tccagaaaagtttatgagttatagtggtcctcgctaaagaagttatttaagagttttaaactggctttgtgaaaaaattcttatattgaactgattaaacagtaagataaagtataagctatgctaaaaaaaaaaagtaccaactactatggacaaaccattacttgagcctatttggactttatattaaatttatttaaaataataaacttttaatatttcatcttgtctaaagttaaatccttacttttaatcatagttaacatattttaaaattactttggataagtgggattgatccaacccaaatcaaattgttaaatgccctcttgaatttttttgtctgttatttaattatatggtggaattaataataaaataaacttcatgtctctgattcaaggctgtctcaaaaaaaagaactgatcaaaatttcataaaaacaaaaaaaaaaaaaaaaaaaaaaaaaaaaaaaaaaaaaaaaaaaaaaaaaaagaaaaaaaaaaaaaaaaaacaaaaaaggagaaaagaaaaaaaaaaaaacaaaaaaaaaagagaaaaacacagaatcaaacaagaacatagaaacaaaagagagaaagaaaacacgaatccagggactcataatcaagacaaaccaaaggacgaagtcgccggcagcgcgcacaagaacagcaacgagcagactagatcagcaacacagaggagagcggagagcaaaacacacaacaagcgagcagacaacaactgctcacgaaccagcaacaacagggagaggagaacacaatgggcggggcaacaaccaaatagcgacacaccaaccatcaagaaacaacgaagaaacgaaagaaaaaatacaacccacagacacctcaccctatgtactgtggcgaccagcacaaaaacaccgacggctataaaacacgcagacgcgagagacaacacagacggggaagcacgagaagccccgagcgactcatcaccgagaaccaacaaagatcccagcagcagacatcaacgccaaccacgagtaacacagcgaatagaccgcaacagaca

SEQ ID NO: 49069 - DNA, 403 bp, Homo sapiens
aggaaatcgacatggctaaaatttgtaactcaagaaacagtatgaaaatattttaaaatactgagattttaaaaacaagttgttaaaattaaagtgattgccattagatattcgggagtgctggcaagaactgctttatttcataatgagcattttatactattacattgataaaacttgaaaaaagtaatgtcaggaattctattaggcattcaggtgatgcgggatgctgctgggtctatggaaccacacttgggcattacttcatgggtcattatgaggattaactgccacctggggcctgagttttgttattttgttaaccactatataactcttaaagggccctgtcgcttcataataactgttttgtgtttgtgatagacttcttcgagtcttaaga

SEQ ID NO: 49070 - DNA, 469 bp, Homo sapiens
aaaacacctgctgggttcacgcagaatataaaggtctttgaaataattcttgatctctaggccaaggagttttacattttaaaataatcaagcgtgcctactgcttgccaggccctgctctcgccttcactcgcattattcaattaatcgacacaggcctgtgcagtgcgtcttaatgacaaggactcctaccctccactgcctgtgttggaatcctggttctgccagttattagctgtgtatcctggcctaagttactctctgccacagtttctgactctgtaaaataggataatagtatctaccttataccattattctaaagataaataaatttaacatatttaggttgggcacggtagctcacacctgtaatcccagcactttgggaggccgaaggtggaaggattgtttgagcccaggagttcaagaccagcccgggtaaaatagtgaaactccccacctctcc

SEQ ID NO: 49071 - DNA, 434 bp, Homo sapiens
gaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagacttaaagaaataagaggcacatcaatcaattgaaatgtgtgggaccttacctggactctgaattaaacaaactgtaattttttaaagctacaccttttaaacatgattggctatttgaacac

SEQ ID NO: 49072 - DNA, 171 bp, Homo sapiens
tccccccttccatctccaaagacgaccccttggcggaggtcggcgtgaaggaggtgaagaccaaggtcaacagcaccttgaccttggagtgtgagagctgggctgtgcccccgcccaccatccgctggtacaaggatggacaggtgagtttgggaccccctgcgcagcttc

SEQ ID NO: 49073 - DNA, 836 bp, Homo sapiens
tcttcacatcgttaatgtcttattcagtcactacccaaggggctgaccttcaagattctaatccatgaaagcttaaaatagtaaacaaatttgaatatagtttaacatacataataaattttatttctagaagaggaggatcagcccttagacatgaaaagtaaaaatagtttattcccagatttccctttgtgcattagtatattcaaccgagtctatccaagtaacaggacaaaaaaagctggcagttgttgctgcgctgtgaagtcttattaggtgagtcagctaattatatggcactaccataaatacagcaggcactgccctgctttgttaggcttgccaaggaaaataaggatttaaagcagcatactacctctttgctatataatgacattttcttcttaaaaatgattttgcaccaattcctgatttatccaccaattattttttaatttatggttgaatgtatttaaacctgaattcagagataaaactagtaaatagctccccaaaataacccccaaatatatttaatatattagctttactctctcctccactgccaaacctttaaaaactgaaataaattgtttttatttcatcttttctctttttctctctctctaaggtgattgccaagactaaagaaacagctagaagggcaaaagacaagaaaatcagtaagatagtaacagattatccaaagtagagcacggctcaggtgcagtggctcatgcctgtaatcccagcactttcggaggtgacgcaggaggatcacttgagtccaggagtttgagaccagcctgggcaacataatgaaacttcatctctat

SEQ ID NO: 49074 - DNA, 429 bp, Homo sapiens
ctctagcaaatgatgccaactggcaccaaattctttttgaatcttaaacatatatgcacacgtgcacacacacacacacacagagcttcggcataatttaggaaatgcataaagatgcccgtaagaaggacttggctatcatttggagtaattgcaggtctttgctcttggccttgtagcacacttgattcctggcatacacatcctagcataacatataacagtgtggcttcttcacctagtgtaggcataaatcctttgcttttcatggttttgtaaaaaggtagtaacatacctattatgctttgaaatttgattcgttatgctctgcataagtggtaaaggctgtattgctttgcactgttaattatgaacaagaaataaaacaaatttgaagatagtattctgggcatactacatgttatattg

SEQ ID NO: 49075 - DNA, 236 bp, Homo sapiens
acaaagacttatgaaacagtttgggctcaaggtctggcattatttgttaatagtcaaatatttcttaaggttatagggtagaaatgctaatttaatttatttctaagcagaatccattggaaacaagaagcttgcacagtgaatttaatagtcttctgagactttgggtcctggagttttcagcatcaacaatactaggcacaggtgtttacgaataaacaaaaatatgtgcttat

SEQ ID NO: 49076 - DNA, 906 bp, Homo sapiens
gtgtcaccagcgctgaccagtagaacttcttcctgtgatgaaaatgttctgtatctgcattgtccagtatcatagccactaacccggtgtggattttgagcagttgaaatgtggctagtgcaactgagggactgaattttaaattttatttgccaagtgagtgaggtttttctaaggttcttttgtgattttgtggccagcgctgtccagtggaacttcttgtgacgaaaatgttctgtatctgcactgtctagtatcatagctactagccccgtacgccttttgagcgcttgaaatgtggctagtgcgactgagggattgaattttaaattttatttaattttaactaacgttaaatagccacctgtagctcgtggctatcggattggacagtgtaggtctaagtctagtgtgtgggagaaaaacctagcttgcaaaaaaaaagtacaaattgtaataaaaatggaaccaaagactcagtggtaattctgtatttctccagacatgaaattcgtgctcataaatacactgatgaacttgggatggatgataaaaatggccgtaagaaatccttgtatttttaaactacttgtctgtaagactggtttattatttagtacactgaaggtgcttagtttttccatggttaatacaaaagaaaacattcttgttaactagacattaaatggattcattcattcaggtgacatttactacatgtttgctgtgcgccagttctgtagtaggttaggaatacaggcatgaaaaacaactagcagtctagaaggggagataggcaagtaggtcaacacagttcattgtaataagtaagtatttttaagtaggaatttaatttagcctttgaggaaggggagtgatagtttggaagggaaggattatcagagc

SEQ ID NO: 49077 - DNA, 264 bp, Homo sapiens
ttactcagctttccatctatggataatctaaccacaaattctcccctgatgtgcagatcttcattcaatatgtgcaaacacactttacagtctatcactttctcttctcctagaagttgtcctgcagcctcctgccaggctccaatctagactgaacgctgggttgggggagggaagaagagaggttctcactgacatctcaggatttcccttcaccatcatcttagagattcccctccaagcagctcttcttaaacaagtaac

SEQ ID NO: 49078 - DNA, 526 bp, Homo sapiens
gccaaaagacagaaatttattgactcacgtatcaagaatggcaggattgccactgggcttcagggaccagggtaacgccattagcaatatccgttatcagccttattctttcccactgagcctggctgaactacagctgccagcatttcctgggcttgcattttcccagcttcgtcacatcttaatttcaagctgaaaaatcctgggaagagacatacttcactgaagtcatttctctattctactcattgtagccaggcaaaatgagattaggattagctcagccagagttaggtgactatccttgcctaatcattctgcatatagatgatttatatttggaccctgtgtcagacttggagagaggagggtcatttcccaaaaaaggggagtaacagtccagaagaattaggattccacaaaaatatcttacggatacatctctctctatatttatctatattaatatatatcttgtaggtatatatagtcatgtttggcttaatgacaaggatatattctgaga

SEQ ID NO: 49079 - DNA, 1222 bp, Homo sapiens
atcagtcatatttaattactaagatattaaagaaaacttgagttttattctattggtaatattacattagggttttgtttttactttttgagacagttactgtcacctgagctggagtgcagtggtgccatcatggctgactgcagctttgacctggctcaagcgatgctcctacctcagcctcccaagtagctgggaccacaggcatgggccaccatgctggcttaattaacaaaatttttttttgtagagacggggtctcaccatgctgcccaggctgacattagtcattcttaagcttctcagttaaattacattatgaaacactttgttttcagaccatgtaaaatacctttcaactgagctctgagttcatcagttaacttctctactctttttaagggagtaagaatagtagagataactttttttcataactttttttttgtttgttttgttttgttttgagatggagtctcgctctgtcgcccaggctggaatgcagtggcacgatctcaggtcactgcaacctctgcctcccgggttcaagctattctcctgcctcaacctcctgagtagcagggattacaagcacctgccaccacgcccggctaatttttttatttttagtacagtcagggtttcgccatgttggccaggctggtctcaaactcctgacctcaagtgatccacctcagcctcccaaagtgctgggattacaggcgtgagccaccgcactgggccagagagaacttttttagtaaacatctattgggcactgagttagtcataaatgtggagacacaggtgtgaagtcacattgataaaatattagtgatatgataaagggacaacaattagggaacggactctttctggacaggaggcaaggaagagtgtgagatgtagggagacttggtagttgcaagcacaggaactggtatgaaaatacgtgcgccagagagagttaagtatgcttggtgtgtagagtatgaggtttagagatgatactgatgtaggaaggggtccagtcatataaaagtctgtgctccatgctgattttcttcaaagaaatgttgaaaggctttaaaatagtgacaatgagctatatatcctgaaggataagtctcatatcggtagaaaatggaaggaaatgacggtagggatgggaattgaatagttaaaatattccgcatataagatgatgtgtaagatgctgctg

SEQ ID NO: 49080 - DNA, 763 bp, Homo sapiens
  misc_feature (635)..(635): n is a, c, g, or t
  misc_feature (686)..(686): n is a, c, g, or t
  misc_feature (698)..(698): n is a, c, g, or t
  misc_feature (739)..(739): n is a, c, g, or t
atcagtcatatttaattactaagatattaaagaaaacttgagttttattctattggtaatattacattagggttttgtttttactttttgagacagttactgtcacctgagctggagtgcagtggtgccatcatggctgactgcagctttgacctggctcaagcgatgctcctacctcagcctcccaagtagctgggaccacaggcatgggccaccatgctggcttaattaacaaaatttttttttgtagagacggggtctcaccatgctgcccaggctgacattagtcattcttaagcttctcagttaaattacattatgaaacactttgttttcagaccatgtaaaatacctttcaactgagctctgagttcatcagttaacttctctactctttttaagggagtaagaatagtagagataactttttttcataactttttttttgtttgttttgttttgttttgagatggagtctcgctctgtcgcccaggctggaatgcagtggcacgatctcaggtcactgcaacctctgcctcccgggttcaagctattctcctgcctcaacctcctgagtagcagggattacaagcacctgccaccacgcccggctaatttttttatttttagtacancctggccaacgcagtgagaacctatctctacaaaaaaaatttaaaatttanccaggtgcagtntcacatgcctgtggtcacagctacttgggagctgcttgagnggatcatttgagcccaggagttga

SEQ ID NO: 49081 - DNA, 332 bp, Homo sapiens
aaaatctgacaagtgggaaaacatcctcagctcttcctgcccctgtttagggttacctttctgctaccctgtgtctaatagaaatgacatgacctgtcaagtaaggagatcatggttttcacctggcaaagtccatgccgaggtggctccaccctttggccatgatgcagatttcagtagtcaggttgctatcatgtagcccttagcagggagagactcttacaggctggaagcccagaccagatgcacaggtcgggatatcaggtcccatgagctgaattttccctccagaatagacagcaacaagtccagcaggtccacaatgcaggcat

SEQ ID NO: 49082 - DNA, 503 bp, Homo sapiens
tatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaa

SEQ ID NO: 49083 - DNA, 262 bp, Homo sapiens
tgaaaaggggattcactgcagttagtagacacacacaaaaccaagtagaaatgggatacaataaaataacaaattagctgaatgttccaaatgagagcttattgcatactctgggcggcaagccacccaggtgttaagggaagagaccaagggcacaagctgttttagtataataaagaaaatatatagaataaaaatagttatactaaaaataaattataattatatataaatattaatcattagtttgtagcattactct

SEQ ID NO: 49084 - DNA, 2229 bp, Homo sapiens
agggcccagaaacatgtgaggaacagcagctcagaagggtctccagactgatgggccggtgatcctatattcttgttgggctgacaactcttctggtttcgggctccaggtgctggcaagaaatctcagagagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaaacaacaaacttgtacaatgaattaatgagataggccatagaaactttatttctaaggttgacatacctatagctgggctcctgtgctcatattcagtggtacattttaaacaaactgtgatcggaaaaaaaaaaa

SEQ ID NO: 49085 - DNA, 2130 bp, Homo sapiens
gctcataaatgacattaaaaacaaaaaaaaaatctggatgcagtggctcattcctatagtcccagcactttgggaggccaaggcgggaggatcatctgagcccaggagtttggggctgtagtgaactatgctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaaacaacaaacttgtacaatgaattaatgagataggccatagaaactttatttctaaggttgacatacctatagctgggctcctgtgctcatattcagtggtacattttaaacaaactgtgatcggaaaaaaaaaaa

SEQ ID NO: 49086 - DNA, 2220 bp, Homo sapiens
agcggagtctgactgacgccggctggggccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaaacaacaaacttgtacaatgaattaatgagataggccatagaaactttatttctaaggttgacatacctatagctgggctcctgtgctcatattcagtggtacattttaaacaaactgtgatcggaaaaaaaaaaa

SEQ ID NO: 49087 - DNA, 2331 bp, Homo sapiens
agcggagtctgactgacgccggctggggccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaaacaacaaacttgtacaatgaattaatgagataggccatagaaactttatttctaaggttgacatacctatagctgggctcctgtgctcatattcagtggtacattttaaacaaactgtgatcggaaaaaaaaaaa

SEQ ID NO: 49088 - DNA, 1861 bp, Homo sapiens
agcggagtctgactgacgccggctggggccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagtgacacacccagaaccccagaattggcataaagattattttaagctgaagacacttgagattcaattgatacagaaagaagccttctcagagcttcctttatctgactagaagctgaaacttctgataaatgaagaccatcataaattccctcttgaggaaagctactaccaggagagagaccaagagtaaatctaccataaataccccatgaccatgagttcagaaaacctacataaacatatattatcacaaaatgccttattgctcatttgttctcctaaaaccacatttgtttttcctaaaggaacctatttgttcatcccataggaacatttactccgtcttccctttccttactaatttaggtatataagcctcaaattctaaccatccatttcagta

SEQ ID NO: 49089 - DNA, 1049 bp, Homo sapiens
ttttgcattggtttttaattcatttaattggtttacactcatttttttttttaacatcccattttggcatttgtatgcccagttaaaaattatgaaatggcacattgtgggattttgtttagcctaaattcctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagtgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtatttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccacaat

SEQ ID NO: 49090 - DNA, 404 bp, Homo sapiens
ttagggccgtttggaaaggggcttgtcctgagagagggggatcggcgctggcagggcagtgcccgtgctcgctggtggcgttgtgatcctggatgtgtccagggaagtcctctccccgttttcttgggcggctccagcccatccagcccccctcatccttcattgccattttctcctatcattccttcataaaaacctcaaataacatcctaacctcgttcctaacagccttagctggaaggggacgaggaggcggctgcaaagcgctcctctctgctactggaagccccttcgtatctggggagtccctgccttttcccagagcctatgcctgtctcttgagggctgtggccatccgcttctgccacccttcaccgtttgagcggctgactttgataagaacg

SEQ ID NO: 49091 - DNA, 433 bp, Homo sapiens
gcctagaacgccttttcccttctcttctcttcatcactgtcttcttcacccctgccccttgccaaattgctctgtatcttgacattttaaacattctcctctttctctaatcacctgcctagattcactggagcaaagctgatggcataagaaatctgctattctccccagatccctcccctgatcatttatagacacttgccatctcccgcattcccagaatgcttatcttgaatttacacctgttgtaaattgccccattcatgaattaggctaatgattgtctttctttgttcaattgcttcatgccgaaggagtcacctctctgggttctcacatgctgtaaattattagagggcgaaaagcaaggtcccagtagtgctcttcaaccaagctggacacaaaatcagagctaatcaaatgctaaaaaaaa

SEQ ID NO: 49092 - DNA, 321 bp, Homo sapiens
ggccaggaacaaagctgagttccctctcctgacagatcagcagtggcattagattctcataagagcccaaaccctattgtgagctgcacatgcaagggatctaggttgtgcgctccttatgagaatctaatgataaatgtaatgtgcttgagtcatgccaagaccacccctgcattaatggaaaagttgtcttccactaaagcggcccctgatgaggaaaggcgaggaccactaaccaacagacactaaaattatttttcaaataatttaagaaagactttccatgcataaatttggcatgatagaaaattaagttaactt

SEQ ID NO: 49093 - DNA, 322 bp, Homo sapiens
gaaaggtggcaagagaattatcaaaagtttccatagatggttgggaagatctgattagtgtttccaaaatgcttatcattctaagaatcccaatagctggcaagccaagcagtggaacttatagtaacaacaatcaatcacttgtctcatcccacatttttgccaaattcaaaaacaccaaatttcccatcaaatgttctgtcagagtaaacctttacctaagtgcttgttttgcttttaatatgtgaatttctgggaacattcccatgggcagcctctaattttttttttttttttttgagacagagtttcgctttttcac

SEQ ID NO: 49094 - DNA, 441 bp, Homo sapiens
tctgtgaaatggatctgcagccctctccatttctgggttcccctggccacaccatgcttatggctgtcccaggagcaggctgacagacaagcttccaccagcatctaaccatggggctcatggacaccgtagagcgtctccacccaacagaatcctgacttgggggcagctgaggcagggggcccgagcgttgaggggaccacgctgctgccccgagacctgctggcatgccacctggccaaccctgacttcgcctgcccgggcgcatgttaactgagttacaacactgagggcacttgaacctggctgcatgaccagagatcgatcacctgtgagatcctctgtgaaacgggataagcatctttaatttcctgggctgttctggaacttcagtcagacaggacacaggagggtgtctgcaccacccacccctgcctcgtg

SEQ ID NO: 49095 - DNA, 930 bp, Homo sapiens
tgacacacaggcatagggtaaatgacctcagcttttaagtcaggtatacttgagtccattccacaccttgcttcctaattgccacctgattttggagaagttttctaaccctctttgagctgctatacaatgaaaaaaaatccctcttgcaagattactatgaggattgatgatgatctgtgtagcatccctggcacttagtaggtgctccaagagcaggtgccattgccacacttcactccagaggaggcagcataactaggagagaagtatatggaccttggagctggccaaccttaggttcaaaggccagcctctgccacccaccagctgagtgacctcgagcaactcatccaatgagtttgagcctttcctttccagtcagtcaaatagatagtagtacttacttcatgggattttgtgagaattaaaagataatgtatggacagagacctgcacagtgcctggtgatgattgggtatccaataaatagaattaatgatgcttatgatagcatttctgcgatgtcttgcaatttcctaagatgttcagtaccttccacccccgacagacaacagcaaaagcaatagtaacatagatccttccccagctgaaccgaagtgataccttcaggaatgtttcaaactgttttcagtctctctgaagctcctgatgcataaggcaaatacccacaggatggccatggaaggagtggaataggagtcctgactggctatcctttctgacccttctgagtgactaagatcctgcagaaatgtgacagaaaaagaaagttccttggagatgggctggaattgcttgtgatctgtccctctgattgtgttagaacgcttccagccaggtccaggtccgttctgccttagcacagcgaatcaatcactgtgacatggagggttttccaaaagagaa

SEQ ID NO: 49096 - DNA, 470 bp, Homo sapiens
tctgaactggctcaaggttttgagccctttaaaaaaatttgtgtatgtgtgataaaaatatacgtaacataaaattcactactttcatcatttttaagtataagtgaagtcacattaagagtacttacaatgttgtgtaatcattgccactatttctaaaactttttcatcattcaagaagaaatattgtaccccgccgggtgcagtggtcacgcctgtaatcccaacactttggcaggcggatcacgaggtcaagagatcgagaccatactggctaacatgctgaaaccccgtctctactaaaaatagaaaaattagctgggcgtggtagcgcgtgcctctagtcccagctacttgggaggctgaggcaggagaattgcttgaacccaggaggcggaggttgcggtgagcggagatcgcaccactgcactccagtctggcgacagagcgagactcccatctcaaaaaaa

SEQ ID NO: 49097 - DNA, 436 bp, Homo sapiens
ataatctggaaataaaaacaaatccctcctaggatcattatatccctaaaagttctttgccccagtcttagaaacatggcacttttgagcatgctaaaatcatgataaggacatatttctcttctcatttcacaccaataaaggaggaaaaaagccttgtcctataggcaccatcaaaataatctacccacccccaactatgccaggctcctgtctctgtggagttcagtggctcctcactagcaggaaagtataagcagagagaccattagttatgacatggagactctagctgataatgctgactcacttcaggagctattatactataaacagtgtgctgaaagccatttatctgcattttaggataaacagcagaaaagtctcaattaaatagattgcaagaaataagctgctgatgtcaaaccaagtgaag

SEQ ID NO: 49098 - DNA, 392 bp, Homo sapiens
tacctgatgtggaacaagtgcctgatctacatttgaattcacttagtccaaccagagtttcaaagttacaacttaggagcagagtcattttggggccatacccaaagctgcctcccatttggaccattccctttaagcattttcacagaccatctcctgaagggatggtcatcgtggttcggtaggttagcaaggtctggcaggaaacaaaaatcaactcagagactctcatgaaggccccacttataaagatctgagcagggggctgggcatggtggctcatgcctataatcccagcactttgggaggttgaggcaggtggatcacttgcggtcaggagttcgagaccagcctggctaacatggagaaaccccatctctactaaaaataca

SEQ ID NO: 49099 - DNA, 285 bp, Homo sapiens
ctttgctggtagtgaaagcagctctaatgacctggcgcccaacagaaccaaatctgtttactctgagctttgccccttcttcatcctcccccagggcttgagaatgaacccacaggatgaaggggctgtggctgatgcataacgggccagctggctgccaagtagggagggtagagtgcctcctctatttccttctgaattgtaaactctgagcctcctctacttcccaagcttcctatgggtgaggagagagggatcagctgagctcattcattcattgccagg

SEQ ID NO: 49100 - DNA, 611 bp, Homo sapiens
  misc_feature (23)..(23): n is a, c, g, or t
  misc_feature (28)..(28): n is a, c, g, or t
tctatagggaaatttggccctcnagccnaaaaattcggcacagacagaagcctgtggaaccagatgtaaaggatcagttctgtgtctaggtactccgttcccacagtactgtcagaaagtaagcaagtcaatttgggatggaatttctacccagtatgttgttgctgtgtggtcttctgacctcctggcttttccattttatcacctccatgggaaaggacttaggcagcagatgtggctgtgccacaacttgccacagctgtgggcttgggtggaggagctgtgagctagaggacggccacacccatagcacagctgacatcagccacacatgaagctgggaagctgctctctactctcagcaccctcagggccaagagaagccccaaaagagagtggttactgcccttattccaggccccagaattctctgctttgcaaatcccaggctgagccccatggttaaccctctctggttctttgctctaccctttggagagaagacaaagcaatgagaagtggaccaagaacagccctcctaatagaatatcctatccaacctgtgatttcagccaagggtaaaataactactctgggtctatcaaaaggag

SEQ ID NO: 49101 - DNA, 348 bp, Homo sapiens
tcgacggagtagaagggcagcaagtgccattcctggatcagagccctgcaacacggggtcagctgcaatttgccccccagggctgagtatcaacaggcacttcccctcgctctgaaaatgcttgggggcatcctcgtgctctctatttggccaagagagaacacgaaccgcaggttatttggcccagaccagtagatgccgtggaaaaggcaccgtggctgccccagaacaggcaaatcacaaaatgcttgccttgggaagcataaacaaagcctcatggtgtaggaggggcagcccccgcctttggatccgggatcagagggaagagagaatacagggctgtttaga

SEQ ID NO: 49102 - DNA, 425 bp, Homo sapiens
ttattcctgactataagttattccctattcttgacaacagtgattgagaatttggtttttggcctgaccatttagtcatctctgtagatggatgacacagatctaattcctttcaagtgagagacaacaggaaatccggtttgttggtcctttcttgtttgtttattttgagctccagtcagttagaaatttagtgcccgctgcaaagcacagctctttgagacttgggattggtaagagggtgtgttgcttacttctggcctgtggctgaatttgcagggccaaagccaaaatctctccatatgtctgtcatctgtgatccatgtgtctgcaagtctataactgagaaaagccttgattccgtgatatgtgagtgtgaaataaattaataaattagttatgtctcttaaatcaaaggagctctg

SEQ ID NO: 49103 - DNA, 338 bp, Homo sapiens
acatgaggaattcttataaattatcatggtgctaggctctgaaaatacataagaggattagagatagccccaactaccacccctaattagacttcttcttcctctgatggtgggatgtactccttgcctagagtggcagcccacagcagcatcaccacctctgattcccagaagggccagttgctagcacagtccatcccacgttgtttaggcattacctggagcccaagggatcttggcatccagaagctcaatttggtgaaaatattggtgtggcttgcacagcagtgtctctcctgtgggtgattccacccaacaactcctaatctctccaaccc

SEQ ID NO: 49104 - DNA, 387 bp, Homo sapiens
tttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaaggga

SEQ ID NO: 49105 - DNA, 1420 bp, Homo sapiens
  misc_feature (3)..(3): n is a, c, g, or t
  misc_feature (6)..(7): n is a, c, g, or t
  misc_feature (9)..(9): n is a, c, g, or t
ttnggnngngaaagaaagaggacttaaggatgacttgaaagtttctggatggctggggatgttaattattggagaaaaggacttcaggaagaccaggtttgattaagagggtgaacagtgggtgttgctggtggtggtagtgattaggagtttagctttagaacaaggagagtttgggatgcttatttgtaatacaaagaggagatgtccagtaagtactgtagtttggacttcactgggtagggatttcaggctactatgctttttaactcatatttgacatctatgtataggtaaatgtctttattttctctaaacaatgtgaatgcctagcacactgcttgacatgctagaagtgtttaatgttgaatatgttgaattgaattgaaatgtaaatttcagttctgttttctataattatatattttactctaataatagtttctggtgtttgaagtatacattattttctttcaactgaacttgaatataatataattttatgaagtcatgagaaagtttggtaaccttccttaaggaataatttttggaaatgtatagacattaaaaaaatagagcctgcacctgaactggctactgttccctgaagcctgtattcctgaccactgtgaaaagtgccatccttgatcctaggcttcctgtccttaatggccattggttgctagtgctaaaactgtgtaagaaggtaaatttataatcatcataggttatttgtaaacagaaaaggtgggggggttggtagtaactgtattttggctctgttcagtgggcctataaattcatttgattacatttaaagttcttttgaaacttaccttggtttaagaagtttactgtattagtccatttgggctgccataaccaaataccatagacagggtggcttaaacaacataaatttattttctcacagtcctggaggccagaagtccaagattaaggttctggcctgtatcattttctggtgaaggcctactcctggcctgcagactgctttcctgctgtgtcctcacacagcctttcctcagctcataggaggggaaatgtaggaggagcagagggagagggagagcaggtgctctgtgtctctcctcttgtataagaacacccagtccaactggaccagggcccctcccttatgatctcatccaaccttgattacctcccagaggcctccatctccaagtactatcacatgagattagggcttcagtatatgaattttaggggaatacagtttaatccataacatgtaaccatagtagcatctttaatactggggttattttgcacttcttttgtatgtgagagagaataaagaacacacctttttaggtatttatacctgaggtatcattctaggaaatgagaatgagtttgtgaaaaataaatgcaaaaa

SEQ ID NO: 49106 - DNA, 323 bp, Homo sapiens
atcatttaactcagtgggtctcatgtctccaaaatgcaaaatagccatcatcacaattaccatcaccatcatcactactatcgacatctcattatcatcaccacaagtattaaggccccagactttataagacatttatttctcatacaatctctggttatgtacttttaagaattggaaaataaaataacgaatggaagaaaagcaaaaatattttataacttggaaaaatcttggccatgaagggatgtggcaggaagtgcaggaggataattttgaaaccatcgtgcaagacagggtttgtaatcaagaagagacaatag

SEQ ID NO: 49107 - DNA, 1324 bp, Homo sapiens
gttgcagctcctgagtgattggctgagtttgttccaaaggggcagccctgtttgctttgagtaggccccaaatcacccagagattttcaggtcatcttgcttgaccaggggctcagccatccgacagactggtccaatgtgcaagcctgggctttatttactcccagccttaccacctgctagtgtgaaaagttgagcagaccatgagacttccatgttaagtgggaattttcacagtgctgcaccagggttagatgaaggtgagatgggggattgcacataaggttctgagatcagtgcttgtctcctactgcatcgttattgttttatcattattaatgtttaagctcttagagtcaaaataataatgcctggagcgtgggtccactcttttccctgggactccattatttctctttgaagcacaggagccaatccccctggtccctatcaggagccacacagttttggttgaagagggaggggctgagagtctggtaggctcatgggtgtggttatccagcgcaggggccagagaagtgccctatgctcttctttccccaccgtgcttggctgactctaaaaattcctgggcacatcacagttactagtcagctttctggacatgtctattcaaagaagtttctggaagatcagagaatcttgaaaaggtgaaatccagtctcttgggcagaatctccaccaccttggtgagccagcacccagcctttgctctgtgattcggggcaaggccagcacatctactttgcaagcacagttagccttctgagaacctgggcttgggtctctgagctatctcagttcatcacaaaggggagaccctggcactatacctatgtgttaagtgagcactttccgccaggggggcttaaggcatataggccttctgatcccatttcctataaaggcatccttcattcatatattcggatgtttactgtgctcctacgtttgtgccaggcactgtgcatacaacaagatagacaaagttcttgtcttcctaggggaggctagtaatgaacagtaaattagacattttcaggttataataaggtctagaaagaaaataacagcgtgatgtaaatatgtgatgctgaggacagttattgaaacacagtagatgctaatttccaagcctctgcagactgtgtttttatttcctgtgcgtctgcatcactggctcacactggaagctggtcatgtaccctaccagttgtggcttaactcttttgtattacatagagcaaactatggcccatgggccaaacctaaacaactgctcttgctccaaatctaataatct

SEQ ID NO: 49108 - DNA, 729 bp, Homo sapiens
aagtgctgggattacaggtgtgagccacgctccagccaattattgctattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactgagtacccagcatggtggatggaaatagatcatgaagtttcaaactaataggaagaggtagaagattctataggcttttgggaggggagatgggagaaaagtttaaggcaaataacaaagaatcagaacggcatccatcttctctatggtgctgatgtgctccagtgtgtaaccatcaggaacaaacctatagtcaaacctgagtatattggctcattgcaacagaggagacagcaaacactatggggaaattgtgggacaattcttcctttgggaatctcgatatttttatctagaaagtgagagaaatggttgcaagactaaacacataattggtaaagaatcaacagtctctgttgcccaggctggagtgcagggccgtcatctcagctcactgcaacctccacctcctgcgttcaagtgattctcctccctcagcctctcaagtagctgggattacaggcatgcccaaccatgcttggctaacttttgtgttgactgttggtcgacgcgggtcgag

SEQ ID NO: 49109 - DNA, 288 bp, Homo sapiens
cagagcaaatgaatgaaatggaatgaagacagaaactacaaatctatatagaccataccaaaagcatttggaaaaaagagaattttcttccaatcaacaactccctgaaagggaaaatcaggccttaattttcatgtgcaatatatacgtctattgattcaagatgattagaagcatgaaaaaaaatttcccaatttcgtcttctaagcatgtactcttcattatcagtgctctactgtctttttgttctcaaggcaaatttaaacttcctcacaaatatcttaatgc

SEQ ID NO: 49110 - DNA, 464 bp, Homo sapiens
gagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtt

SEQ ID NO: 49111 - DNA, 410 bp, Homo sapiens
tctttttaatttctggatcacatcaattttattctgacagatgcagcctctaaaataagctgtgtgatgcactcaaacctaaaataaaccattatttcagggttaggtgcgtcatacctgcaaataacctcatttatctagagaaatgtatttaatgcttattgtataaataccagtgtttcagcgtgatctataataccatctgtcacttctttttgtccaatacataattcaatcctttattccagttttttgagaaggagagctcttgcatattatcttatacatactgtgacaagaacccagggcatattatggaaaatatattaaatattatccaagataaaattttaatgcaagttgaatgaaatgctatctttgttgctaagatatgcattaaagtaagctta

SEQ ID NO: 49112 - DNA, 580 bp, Homo sapiens
tttgttaatacacattcccatccaatacactgcacatcatcagctttatcatcattaaaataagcagaattggctgggcgcggtggctcacgcctgtaatcccagcactctgggaggccgaggtgggcggatcacgaggtcaggagatcgagaccatcctggctaacatggtgaaaccctgtctctactaaaaatacaaaaaattagccgggcgtggtggcgggcgcctgtagtcccagctactcaggaggctgaggcaggagaatggcgtgaacccgggaggcagaggttgcagtgagctgagattgcaccactgcactccagcctgggcgacagagcaagactccatctcaaaaaaaaaaaaaaaaaaaaagcagaattgctgtttgatgaaatatgattgagtgcctgagacttataagcagaactgtttttgtagagcattaagaaatacaggctgggcatgggcatggtggctcatgcgtataatcccagcactttgggaggctagggcaggacgattgcttgagcacaggaattcgagatcagcctgggcaatagagtgagacttcatctctac

SEQ ID NO: 49113 - DNA, 422 bp, Homo sapiens
tctacctgaatccccaggggaactctgggatgtcagtgacggctcaagcattgcccctgaggcaagggagctgggctttccctaatcccccactccctcagtctcctggctaagcgctgtccccaggggacttaatcacccaaacacttccccaagagtggcatctgctgaccactggaggcactggtacagtgaagcgacagaagggatcagagagggtcccaggtggagcacagcaatgtggctgaataataactatattaattcatatagttaattctcaagcaatggcaaagtgtaggcagcttcttgtctgcaaacgtttccatgatatctctcctgcagccagacgggtcttttcctgccgcctacacagaatggccatggagcatccccaactcttattaaaatggaaaaaaaaa

SEQ ID NO: 49114 - DNA, 454 bp, Homo sapiens
ggagtgggaagggaaatctgcattttaacaagacctccagattattcagaaaccccaatgtttcagagctacttctttactctgtaatatcttctacatgagaattttaatttatttgtatattaaaaggtgcctttaaaactaaatccatcagcaatcatcaaatgagtatacttgacaacacttagtctgctttttcccctaatatgttatggaagatgggataaacgtagttaacatagactgttccgactataaacaaagccaatttaagtttgattggaattatatttttggaaatatatttgaaacatatttgaatactttgacttacaggaaaattaaatataacctctaaataacaggaatatcatatctgaatttttatgttatcttttatcataatattccttgggattacctactgaagacagtgattggaattttgaaaggc

SEQ ID NO: 49115 - DNA, 508 bp, Homo sapiens
tcagcaggtcgtatacactctctaagaagcagccatctcttaaatggcagaagaggacctccctcgttggactcatgaggattcactacagcaacatgagaaatctctagctcagtgaccctcacatattagctactcagtaaaggttgccctcccatgcccctgccctggctctcttttcccacacagcccacttctctctctgctctccttcctccgagttctccatggccccttgcccacgtttattcatctctgtctctcaccccacttcctgtaatgaacaacactgtcctcactctgtatgtatctgaccccaacttacaagtgtgttatatctaaaaatccattaataagtcaggtatcagaactactcttgtgcttttctaggggtggctcacacctgtactcctagcccttcgggaggctgaggtgagcagatcacttgagctcaggagcttgagaccagcctggccaacatggcaaaaccccatctctactaaaaatc

SEQ ID NO: 49116 - DNA, 448 bp, Homo sapiens
gaacaagttacttattttttttaactaacgttattttaattgacaaatcataattgtacccatgtatgtgatgttttgatatatgtatacaatgtgggatgattagatcaaactaatgaacacgtccatcccctaatttactgacaattttcatgatgcgacatttgaaatgtacccacttagttattttgaaagatacattattattgactatagtcacgctgctgtgctatagatttcaaaacatataatccagcaacccaacttctggatatagaccaaaaaaaaatcaaaatcaatatgtcgaagggatccctaaattcctatgttcactgcagctctattcacaatacccaagatatagaatcaacctaagtgtccatgagtggatgaaaggataaagcaaatgtactatatacacacaaaggaatactattaacccttaaaa

SEQ ID NO: 49117 - DNA, 230 bp, Homo sapiens
cttaaacccaggagtttgagaccagcctatttcttaaaaaaaaaaatgttaagggtatggaaactaactgggcactctcatgcatgactgaagcgtaaactggtacctttagagaagacagtacaaaaatgcaaaaactaagatgttaaaaaaatgtcaaatgtgtatttccccccagaaaacctacttttaggaatacatcttatgattattttatttttttgagatgg

SEQ ID NO: 49118 - DNA, 226 bp, Homo sapiens
tgaagcttctgaaatatcagctactagtttcaaaactctcccttctttggaggcagttagcataactacaaatccaaactagagatgactgataattaaaggggaatctaaagattgaataactaaacctctaagtttgtagttgtgaaactgaggctgagagaaggaaaacaatttagcaaaggctgtccatctctcttttttttttttttaagatggagtttca

SEQ ID NO: 49119 - DNA, 894 bp, Homo sapiens
  misc_feature (188)..(188): n is a, c, g, or t
  misc_feature (221)..(221): n is a, c, g, or t
  misc_feature (264)..(264): n is a, c, g, or t
  misc_feature (421)..(421): n is a, c, g, or t
  misc_feature (507)..(507): n is a, c, g, or t
  misc_feature (563)..(563): n is a, c, g, or t
  misc_feature (676)..(676): n is a, c, g, or t
atcaattttcccaattacaatgtgtaaagttaaccctaaattttaaccaagtgactaatttatgtctatacaaatgtatccaagtcagattaaacccattatctccttgagtctcatgcttctcattttttctgtatggctgtgcttaggaccaggaatcatacagtactggtgattcttttagtgantagattttggctaacatgtatcaccggtcttantcccagtcacagagatgtggtttccgacatgaaatccttacanaaggaaccagaaagtgcatctgtggctaaaaagatccatgtccttgccaacaactgttctgtgggactaaatctgaaggtattatatgcaatgtgagagacatatctataaattaagtttaaatcctgtggcagtttcctctttaaacttacagacntctacttttttcttatccaggataagaattgatttttttcatgatgctttaaatttctcttgtatcatctagcaggaacttgtgcnagtttgacaatgtgcttggtaggcggtgttgctccgtgattaagagcacaggctcnggtgtttcttactaactgaatctgcatcaaggtctaggtgtatctgtccatttttgccaagtttggggcagtaacagcaaccccagcatctcagtggcttacaaaacaaaggngtattattctctggagcgctatgcctctgctggtcagctgtggctctgctcctgtgacttcattctggaattcaagatcaagaattggtctggaacactctatcccagtatcagaggaaaaggagactcccaagttaagcaatggcccttaacatttctgctcagacatggcacaagttatccactcacattccattgaccggacaattcacatgtca

SEQ ID NO: 49120 - DNA, 191 bp, Homo sapiens
atccctataaatagagaagaccaacggcctctagcatgtcttgaaattccttctatattgggttcagtctaggaaactgttgcaaatcaggtgtccaaggcagattcttaagttgttaataaaaggtcttagggccaggtgcagatgcaaacacctgtaatcccagcactttgggaggccaaggtgagagg

SEQ ID NO: 49121 - DNA, 1053 bp, Homo sapiens
aaatgttggctatccctgctgttgtctatatatcaattttgtctacccaacacagctgtaaacttctcaaggtgaggagtgagccatcactctttgcacctcttgctgtgattgacatggtataccttaagatatatgttaattcctatgtcttaataaatattggcttatggagaatttgttggagcaagtacagaccctatgtttaacttcttttattcaacagaattaaaaaactagctagttctctcaataaaataatactttcttttctttcttaaaatctagctgatctggtctaaaatacacatgtgggaggcgggattgtagaaatatctcaaattaattagcgtctagctctttgtaaggtaattgacagtctgagttagttgcttcccccactgcaaagcagcaaaatctgctctcaaaggcttcacgtagccgggaaaactccgttcccaattcagatcctctggggagggcatcaattatttcctattgtttttagcaccgattgttctgtctaatttgaaaggatccaaaaaaggaaatgatacttgggcattagtatcattctccatcactcttgaaagatatatgaagggaatgttgggcgcaatcagtctaggaaacatatttctcccataacaataaggccagttctttttgctttgaatcagaaatagctccatcaggcccatgaaggaaagggaaacaaaactgagtgccaagcatatgataacatgctcagcatcatatgacattaggggattgcaaattgaaacaacagtaccaccacacacctatcagaatggccaaaatccagaagactgacatcaccaatgctagtgagaatgtggagcaacaggaactctcattcacggctggtggggatgcaaagtggtggagccacttgggaagacagtctggcagattcctaaaaaggtaaacatactcttactaaacaatctagtagatttgctcctaggtgtttacccaaaggagttgaaaacatgtccacacagaaaacctgcacatgaatgtttatagcag

SEQ ID NO: 49122 - DNA, 891 bp, Homo sapiens
ctttggggctggctgtggtgagtcactcagaagtctggctgtgacctggatgggctcaccagagtacgctagtggtagtgggaaaacaggcagagagaaaggagtgtcaggagcactcccagggaggctgttgtagatatttccattcccagaacagtgatctattgtgacagtctcagaacagacaacaagaattacaggtaattttctcattctcttgatatatttttagcaaaacttaaatcatgaatagaaggaaaagatgccattggggaaatagaaaaactcaatcattttataaagcatacaaatcataaggatgactggccaatagcactcccactttggtcttacctaaagttgggtggacaagaataataaaagtcctcattttatatccttccaaaatcagatttaaatgctgccagcatcttaatggaagtctgaaattgattgataggatgtagaaatccaaattcactaaaatagggggccagctacataaagtcctagaaggaaaaagtgcctcgcttttttctgccattatcctaccccctagtcatctggggaattgatctatgaagcttgaagaaggggcatttaacatcagagtggtgcaagggcagtgttgagatgctttaagcagcagcctgagctttagcactatttgaaggggagaaggttaatactaataatatttgtgttatttttatgatatattactgtttacagaacactttcatttgatcccaacatcaactgctgtgatagaggcagggcagatgttgtggtctcattacatagaatgtaaaactgaggttgaaaaatactaagtgacttgtctgtagtcaaatggtttttaaaattataaagccaggccttctgactgtc

SEQ ID NO: 49123 - DNA, 398 bp, Homo sapiens
gcctgggggcagtgctacccacatatgttaccttcaaaagacacatctatccatagccctggtaacaggcctgctgaactcaccctacctcagtgctgaagcagccctatgacttgactctatcccccatctattgtggttaatgggtgtctagtaggagccatgcctattaagaccctgctaatgggcctgccatctgcagacccagaagtcctcttgtgacccacctccaaccttgcttgaccatggttccagaggtagtcccatctgattggtaccaggcaggaattgtgcccacctgtgcccgcagtaacaggcccttcaactgtgtacctgactacagacccagcagcatccatgtgagacagctctagccccagttaatcgtgatcttggag

SEQ ID NO: 49124 - DNA, 320 bp, Homo sapiens
tggccacgtctgacttacgagaaaactagggagccattagctggcaccaccggcccagctgtcaggtggtggtggtctgcaggcagtgctgtgagtgccataccacccaccccatgcctacccacctccctcccacgctggcacttgctgtaggggctgctgcaggacaccactaacttgtttctcagcccagcttggcccccatcctcagagtccctgcatctctcccaggcctcactcttactgtcagatatttcaaatgcacgcatcacacagtgagcatccaagggctcatcagtggccctggcctggctctgatt

SEQ ID NO: 49125 - DNA, 406 bp, Homo sapiens
ccaaaccatgtcagacatgatatgatcagatttgtgttttgaaaaattaacactgcaatgtggagaattgattggagggaatcagaagagtccagtaagtaggaaaaagtaataacttacactagggtggtagcagtaagaatggaaagaagtagatgcatttgaatgatactcaaaaggtgaaaataactgttcttagtgatgagatagatgtagggataagctgaagcacttaatgtaaagggacggatggtgttgtctttcattaagatagggaagagtaggagattagatttccagagggaagatcatgaggttgaatttaaggacgtctttgagttttaaatgcctctgcccttcttaagtgggagatgtccaagttaagccatttgggatatatgtatct

SEQ ID NO: 49126 - DNA, 4683 bp, Homo sapiens
ccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgagatgaagctgcaagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccgggggccctgtgtggctgtcctcgaggaccatgacaagcatgtgttcggtgggtttgcctcttgctcttgggaggtgaagcctcagtttcaaggggacaatagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaagggcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatctcagggccctagaaagtgctaggaggaagaggttaaaaaaaaaatttgtccgcgttgcaaactattataaatgattgccacattgcaagctattattttctcccaccatattttttaattaaaaaaaagtctggggccgggtgcggtggctcacgcctgtaatcccagcactttgggaggccggggtaggcggatcacctgaggtcggaagttcgagaccagcctgaccaacatggagaaaccccatctctactaaaaatacaaaattagctgggcatggtggcacatgcctgtaatctcagctactcaggaggctgaggtagtagaattgcttgaaccagggaggcagaggttgtggtgagccgagatcgtgccattgcactctagcctgggcaacaagagtgaaactcagtttcaagaaaaaaaaaaaaggctgggtgtgatggctcacgcctggaatcccagcattttgggagcttggggcaggccgattgcttgagcccaggagttcaagaccagcctgggcaacatggcgaaaacccatctctacaaaaaaaaatacgaaaattaaccaggcatggtaacacatgcctgtggtcccagctacttgggaggctgaggtgtgaggatcatttaggcctggaaggttgaggctgctataagctgtgattgtgccactgcactccagcctgggcaacacagcaagaccctatgtttaaaaaaaattgtgtacctggtttag

SEQ ID NO: 49127 - DNA, 4982 bp, Homo sapiens
ctgggcttttccaggacagtgagctgataactgttcccaggccatgtaggtggccagcacaggacaggtcaccttctggcccacaggaacttcttgcccaggctcaagctgccccttcgcacaagggcctctgggctctgagacacagacaggacttcgaagcctgtccagatgaggcagttggaatctccccagcttgtgggggctggagtgcactgttgtgatcttggctcactgcgacctctgcctcctggttcaagcgatcttcccacctcagcctcctgaatagctggaactatagtcacacgccaccacacccggctgagagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgagatgaagctgcaagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccgggggccctgtgtggctgtcctcgaggaccatgacaagcatgtgttcggtgggtttgcctcttgctcttgggaggtgaagcctcagtttcaaggggacaatagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaagggcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatctcagggccctagaaagtgctaggaggaagaggttaaaaaaaaaatttgtccgcgttgcaaactattataaatgattgccacattgcaagctattattttctcccaccatattttttaattaaaaaaaagtctggggccgggtgcggtggctcacgcctgtaatcccagcactttgggaggccggggtaggcggatcacctgaggtcggaagttcgagaccagcctgaccaacatggagaaaccccatctctactaaaaatacaaaattagctgggcatggtggcacatgcctgtaatctcagctactcaggaggctgaggtagtagaattgcttgaaccagggaggcagaggttgtggtgagccgagatcgtgccattgcactctagcctgggcaacaagagtgaaactcagtttcaagaaaaaaaaaaaaggctgggtgtgatggctcacgcctggaatcccagcattttgggagcttggggcaggccgattgcttgagcccaggagttcaagaccagcctgggcaacatggcgaaaacccatctctacaaaaaaaaatacgaaaattaaccaggcatggtaacacatgcctgtggtcccagctacttgggaggctgaggtgtgaggatcatttaggcctggaaggttgaggctgctataagctgtgattgtgccactgcactccagcctgggcaacacagcaagaccctatgtttaaaaaaaattgtgtacctggtttag

SEQ ID NO: 49128 - DNA, 1180 bp, Homo sapiens
atatgttgataaagggatatatgttgtccttagaaatcacacaaatcatgaccacaataatttatctgtaactgctgctaattttattgagcagagaaaaaagaatatacatatataaacatgtataggtgcatacacaatacacccggatatgttttacacataattttgattctgatattttagataacatctgttcacttttaaacaatctgttgaggttttgggactgttatctacattgattctcttaggaatagtggacagaatgactccaaagattctcagaaccctgtctcttgaagctcaatcttatttgggttcatcactgaaaacttagaacaaatcagtaaagaatcctgtattgaagaattaagtttgagtttaagcccactcaccgcagggctggtttttgcatgtaatactcccatgatgtctggggaaatgacagtttctgttgaattataattctccggtttaagggtctccttcccctggtgtctgatggtgagaggtctgaagagcatttgtcagagtacattaggcattctcaacctacttcatgctttacgagagctgagaaatcagacgcaccggcctttattattatatatgctacatctgttgagtatttttaaaataccaataagaggacttgtttatttcataaaccacttcttccctctctttcaaagaaaatacattattaccatacttttacattagtctgagaatttttgctaaatatgattaagtattccaaaatataatggcgtcattattcttgacttttttagagaatatacatcttaagactgtattagttctcagagcaaggcatcatctactcccctgcacctgagagtctggccccagattccagatgtgcggacagcccatgaccgaggtgcacacagtgccctcttgaataggaaggtcagccagtgaggcggcagcataacttgcaggatggacttatatcttaccatctcttcctgctaccaaaataaaaaaataaattgaaagacaagacccaccagtctagttttgtagacctgtgaaatgtgtctttatttcttggcattagaagaaagatatttttaatccatatcgtggttttagagttgaagtgaattgatacccaattttccatcttagatctcctttatcaaaaaaaaaa

SEQ ID NO: 49129 - DNA, 630 bp, Homo sapiens
attctgtgaacgtgtgctacttttgaaaaatagaggaaggggtgttggaagcctagactggttctcttgccactcctcaaaaagcaaaattttgcagcccaaatattaaaaattgactccgcgtattccttctcccccacagtggcacacaactgggcaggctccatctcgtctgctgctggaacccactagaaaccaaatgagccctccagcaggcctaatcactctgatctgtcatggaccttctagctggaagagttatgccatcatattatcccaacactcatcagtgtgtggaggacccccttttactgaatgatttattgctctttgcagaattcctttggctgcagattttatttctgagtcactctgttcagctcaattggtcgccttcagttaccgtggcaaccagcagatggggttctttgacaagggtcagcggggaggctgccttggtttggacagaagaggagctaaataaaaagctttcagcattgacggttccgtagcggacggccaggagttgttatcaaattacttgcattaaaacctaattaagatgtgtgccaataagtgggctgtagtgattgaatctggttacttagctgctgtgggcccaatcttatg

SEQ ID NO: 49130 - DNA, 672 bp, Homo sapiens
tttttataaaaaatttttaaaagatatatgtagacacaaagagagagagaccctgtctcttaaaaaagaaaaaaaaaagcaagctgttttctatctatagtggatatacaattatacattcccaccagcaatgtataaaagttcaagtttctccaagtccctggcagcatttagtgttacagtttttttaattttaactattctaacaggtaagtagtgatatcttacggtgatttcaatttgcatttccctgatgtctaataatgttgaacatgttgtcacttgtttgctatttgtatgtcctcttcagtgaaatgtttcttggtgtcttttgcccttattttttaggcagggccttgctctgtggcccaggctggagtgtagcggtggtgaagtcacagctcactgccgcctcaaaatccccatctcaagcgatgctcctattcaagcctccctagtagctgaaactacagatgagagccaccacacctgtctaattttgcccatttttttgaattgactttttttttttaaactgttgagggttctttaaatattctagatacaatcagttgccagatatgtgatttgcaaatgttcttccagtttgtagcttgtctttgcatcctcttaacagtctttaatcaggtaaaaattcttaattttcatgat

SEQ ID NO: 49131 - DNA, 250 bp, Homo sapiens
tttttataaaaaatttttaaaagatatatgtagacacaaagagagagagaccctgtctcttaaaaaagaaaaaaaaaagcaagctgttttctatctatagtggatatacaattatacattcccaccagcaatgtataaaagttcaagtttctccaagtccctggcagcatttagtgttacagtttttttaattttaactatctacagagtaggaactatggatcatcacttcgtagcatagtgacgtgtc

SEQ ID NO: 49132 - DNA, 526 bp, Homo sapiens
tttaaagttccctagcattttatttctcacttggactgttaatgaatatttctaaaaagcacactaagagttcaaagttttaaaataatggtaacataatactgttattatatctaacacctactagtatttaccatgtgccatgcactggtctaaaagctttcatatatttatttaagcttcacaacaactctatgtggtgggaactcttactgtctccattttatagatgaggaacctgaggcacagagagatcaagtaatatacctgcagctattaaatgatggaactaggattcagaccctgacaggctggctctagagagtgtgctgtcaacaccatgtctcttcagaaggcatttctttttcttttttttttttccagaaggcatttctgtcatgaagggttatttattgaccagggctttttttttttttttttggactgtcttgggtctcctaggctggagtgtagtggtgtgatcttggcttactgcaacctctacctcctgggttcaagcgattct

SEQ ID NO: 49133 - DNA, 2873 bp, Homo sapiens
  misc_feature (680)..(680): n is a, c, g, or t
ctaaacgccaagagttgagcctgtgggtctctccataagagttttaaaactcttgccagttaccactttatccaatttgctatcattttcgtattatcagctatcgccctgtaaaatattcaaaactagctatttctaaagtaaacattttatctgttacttttaaccagataggtgtctttgtcatccttctactataaattgttctttgccaacctgtacaggtagatgaaccaggcgagagttttaatcagccttttcttgtcccctttgtaagaaagagatgcttgccatagagaaggacatgagtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaanatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgatttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 49134 - DNA, 1471 bp, Homo sapiens
cactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaata

SEQ ID NO: 49135 - DNA, 3140 bp, Homo sapiens
  misc_feature (947)..(947): n is a, c, g, or t
cactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaanatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgatttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 49136 - DNA, 3071 bp, Homo sapiens
  misc_feature (878)..(878): n is a, c, g, or t
tccagtaaggtgtgcccagctttcttctgggcacagacaagaaagatggaaagtataggttaaagtccccactctaaagtgctttacattttaaatgtggaccacaaaagtgcccacgagccaaaaagattccaagaagctgtgtaagcaaatccatgattgaatgttacaaacgtgtgtataaagtgctgtgagatcagaaagccaggaagtggtcttaaaaaaaaaaaactacaaccaaatcttctctctgggttcttcaggcaatttctctgcccacattcccatttccctaagatattccataagggccagtcacggagaattcatacctgaaagggaaactgttatttgtgttgttgtcaaagatatgtggactaactttcagaactacccactgtgtttccttggcaggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaanatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgatttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 49137 - DNA, 1303 bp, Homo sapiens
cactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaata

SEQ ID NO: 49138 - DNA, 510 bp, Homo sapiens
tgcccacgagccaaaaagattccaagaagctgtgtaagcaaatccatgattgaatgttacaaacgtgtgtataaagtgctgtgagatcagaaagccaggaagtggtcttaaaaaaaaaaaactacaaccaaatcttctctctgggttcttcaggcaatttctctgcccacattcccatttccctaagatattccataagggccagtcacggagaattcatacctgaaagggaaactgttatttgtgttgttgtcaaagatatgtggactaactttcagaactacccactgtgtttccttggcaggttccggagtctcaccactgcatttttcagagacgccatgggcttcttattaatgtttgacctcaccagtcaacagagcttcttaaatgtcagaaactggatgagtaagtgggactgagtaatgtgcattggccgctttgggactcaactgccttaggtgcttgttggtcttgcaagatgaaaccagattgggtaccacagattaa

SEQ ID NO: 49139 - DNA, 3074 bp, Homo sapiens
  misc_feature (881)..(881): n is a, c, g, or t
agcgggcctttgctgttacacaggaagagagcaggcagcatcagtatcggctcagcatccttcccccttctgttcgattagaagctgatcgaagcaacagtgccataaagaaatgggctagatatttccagaggctgcaatctggaggcgtttggaggtaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaanatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgatttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 49140 - DNA, 3619 bp, Homo sapiens
  misc_feature (947)..(947): n is a, c, g, or t
  misc_feature (3505)..(3505): n is a, c, g, or t
cactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaanatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgatttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaattaaaaaaaaaaaaaaaaaaaaaaaaaaaaaaatttttggggggttgggtggaaaagtttttaaaaccttggtgggggggggggcccgggggttaggtgaacactgggcccaagaactcggtgcccagaggaagaaccgcggccccaggaaccaaagtggcttcggggtttctcccccaaataaaaaaaccgccgcggggggccaccacgcgagggtttttcggaaaacacaaaattcccgaaagggcagttccgggggagcgaccccataaccggggcgctccttaatcacaaccagcggagggtcgccagagcggaaggatggcgaaatattaaaaatttaggccgcagcggccggggtggtagcncacttgaccacagtctgatctcatacatacatcacacagacaccacatccaacatccactaactaccacccagtcgctcccaccacactctctgcccataccctccacagacac

SEQ ID NO: 49141 - DNA, 491 bp, Homo sapiens
tgatctgcccacctcggcctcccaaagtgttgggattacaggtgtgagccacttcacacggcctatacctttaacttgaaatttactttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaa

SEQ ID NO: 49142 - DNA, 456 bp, Homo sapiens
ctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatgtaaaaaacacagttgtttcatgtttttgtttctttactgtttttctttgtttttgttaagaatgcattcatttattcaaaattgtttattgtagaataatcaggcattgcgctaagcactgaagaatataacaaaacaaaaacaagtctctaccttaaggagtttgcatgcttgcaggggagacagacattaacaaataattatacaattaaactgtaattgtgacaggtgccatgaatgaata

SEQ ID NO: 49143 - DNA, 422 bp, Homo sapiens
ctattttgtatcacagtaataaagcaacttttagtgtttagcctgtgtaaatggcacctccctattcttttcttactgtcctttgcaaccctgaagttcagataagaagcaaaggacagtgccagctccatggccattgtcctcagtgcctggtgtcgtgctggtctaaaagcctcataagcccccttaaatgcctcctcctacattccctaagtgtttcactcagaggttggctatcctcttttctgtgtatccttcctaaccagtgatccctcagtaatgcaaggttagcattggttaaagtgagatattattgtccatccccaaagtggtttatactaccaggcaggcagtgtagaaagcctttgatttcatgcagaatgcttgctagttatcttttgtgtcactttaaacgaattgat

SEQ ID NO: 49144 - DNA, 372 bp, Homo sapiens
gatctgagctgcgtcatcaggccagtgtcacaccgtcatttatgtgtcctcctcgagcagtgcaagtctatcatcctgggtgcgggaatggaacataactatttggggagatgttaaatggaagtgttagcttccctccataagagctcacttaaattttttttttaaattgaaatcaaatccagaaaccataaaaatgtcccattttaaagtgtacattcacaaggttgcataaccaccacaatgatctaattccaggacattttatcaccccaaaaagtagtcgctgcctgtcagcagtcattctttctcatctggcatggcaaccacgaatctactttctgtctctatagatttgcttattttgaacat

SEQ ID NO: 49145 - DNA, 702 bp, Homo sapiens
ttaaatgcaaataaaatagctttaaaaaaccctcaaagaaaatttagcacaaaaattggatgtaaacgcatctaatagtgtacaaaatataaagctagattactttttacagcaacttgatagtaacaaatctccaattattttccatatgaataaatgagacatcaaatgcatacatataatttactcctataaatttagcaaaatgcaaataaaaattataaaacttttcaagttagaaagtggtttaattctttagttctgttttttttttttttatttcctatcttctcctaaagacagtgtctcttttcaatctctaattactcaattagcatttaaaagttagttggggaataactgtgcttcctctagggagaagcaggatcatggatccatgcaagttaattaatgtcgtatctccatcattcatttccctctaaaaaggaaataaccctactccagcagaaaaaaaaaaggagaataaaaattcacaaaattaaatactgtttggcaccaattggttgtctatgctatttaattctggtagttattgataagaaacaagtaaggaaccttacagtcattcatgactccccttcttcctcaccttccacatccaatcaatcactaaaacatgcctaaacagacacctctcttgtttgttccttccggatgttactatttaaacaggtcacaggc

SEQ ID NO: 49146 - DNA, 173 bp, Homo sapiens
ataacaggcatgaaccagtgtgcccagccaccctccaggtctttagatgccagcgtcaactcagagcctgtgtccatcggtcctacaatgtgaggggtctctgtgccagagtgctcagccctgtgagtaaatgccacgttcctttgcgagaacattccagcaaatgctggcag

SEQ ID NO: 49147 - DNA, 436 bp, Homo sapiens
gagactttacagaggtgattaaggatttggggatgaagcagttatccaggattatctgggtaaggtgggcctgatgtagccacaaggggcctcctaagtgaaagagagaggtagggtggtcagaactagagagaggtttgaaggtgttacaccactagctttgaaggcagaggaaggggccacaagccaatgaatatatgtggtccctagaagctggaaaaggccagggagtggattcttctctagagtctccagaagaaatgtggcccttctgacaccttcatttagtccacagaactataatttatcttagtttaagccactggtaagtgtaattgtaattgtaatttgttacatctgctatagtgaaactaatactgaaatttagaaaagatgggtaacttattatgtggtgaagtttaaaaaagataagtaa

SEQ ID NO: 49148 - DNA, 3281 bp, Homo sapiens
cagcgttcacctctcagccaagtccaatagcactcacttaggtgtgcatctgtggctttctctctgtctggtcagtgctcctttatatgtccataccccctgccagagggcagcattgagggtgtacagagcccagtgtgactctcctgcagctggggacatagaagagctctgtgacgatggcagatgtggttctccagcctcttgcctggctgccagtgggagtagcctgtctgttctggcacagggggctgttccatatggagggtcagaaactggccttcacagccacccaggcgttccttccacttctgcacgtcttcctttccccatgaagatttgggtgtaccctggttgtggtctctgaagactgggcaggcctgtactttgtgaagctttcagctgtctctggtaggcctgatgaagcctatctgcagaggttggcctgaagccataatgagcagttctgttctttttagcccttgtctagtttatggctctgttgcagacatgcctttctgtgtcttggttaaaagtactggtgtgtctttgcatttaggtgtggtctgtgagtctgggaaagcttctagaggagagccctccagggttgctctttggggtgggagtagtgggagcggaaatggaacgctgactgccctcttaaagccagaagggtacttcattcagggcaggcagttggcatgtgtaggcactcaggagtcttccttcagtttcagcggccggtgttcatcatcaggagtggcagggttggatatgggagtgagaatgtgcctctgagattgaccagtggccatagactccagcaagatgtgcatcttggtctgagaggcacccactgtaccagaaaccagacttgtatcgaccaatggcttatcagccccaggaggcttattactgccacaaatgtccctgatggtgagcagcacttggccactactgtctgatgttaaccagagttatgggggtggtttctgcaaatacacaatactgtggaggggttatgtggcttacccagaggtgcccagatagcaaatgaaggtgtaagattggaatccctgtctttctggttgacccttggcttggctaatcattcattcattcattccacacacattgatgaatgccgactctgtactgggttctgttctaggaactagacagacacatcacctatgctgctcttgtggggcttctgttccgctgggggagacagtcagtagtaagccttcaagcaaaggcatggctgctggtgtgatgagtgccatgaagacccataaggctgcgttaaaggagatgggtggtccaggaaggcctctctgaggaggtggcatttgagcactcaagtgccttacactggacttctgaccccatgagctggaacttaggatatctgatctagaagtacctctagaagtcctcttcccaataaacaagctaaggcccagtgagcttaaggtgtgaattcatggggtgattcatgggaaagatgaaattaaacccaagaaggacaagtataatagccggccactgctctgctcacaccagccttgggctccagccctctgccttttcatcccagaatgtgttttattatcttcaagactcagccctttgaaagatttagactgccaaattgcatttattaacaataataaatctattttctcatggctgggtgtggggagggggtagaaattttaaacacatttgtgacggttgatcagccctccaggtaaggcaacggctgactgcctggagctggtgtttttcctgcctaggcggagacaccgcccaattttgtaccaccagctgctgtcactgtcagagtggaatttccattggtgtttctgaaatagcagtgtttcctggaggacccccatttgtactttctggattccatctggacctggtttagggggttagatgcttttgaatgggggctggagagaccctactgatgcctctgaccagagatggtgaggcaggactcacagggcccccagggtttattttagggagagagaagcccacagttaaatcagaggtcacaaatacagcagcagaccccacctctcccaaggaccagactgagctataattggccaataatttcatctaaaagcaggaatcctacatcaatttgaaaggagcttctggctgaagtaagactttattaattagcctgttaggaaaatagtttcccagtattatgagggctggataatttcatgcccactgtttttcttgaagcttctcaaaggcagacacagccgcgtgcagcggctcacgcctacaatctcagcacgttgggaggtcgaggcaggtggatcacgaggccaggagatcgagaccatcctggccaacatggtgaaaccccatctctacaaaaatacaaaaattaattgggcgtggtggtgggcgcctgtaatcccagctactcaggaggctgaggcaggagaatcagaggttgcagtgaaccgagattgtgccactacactccagcctggccacagagcgagactcagaaaacaagggaagacactagattttcatttttgtactaaatagaaaaagtaatatctttttaaaaatgtgttttgtttgtttttaactgtttgttcatgccaatgtgccaggcaccatatttattctttaatctatacagaaatgctgctggatgaatggaattatgctcactctgccaatgagggaaccaaggctcagaaaggttaagtaaccaacctaaggtcaggtagtactgaggagctgtgcttggatacaaaaccaggtcatccaacctggaatcttagctttgacccccaaccttctcccggcaactttgatgataatatggaaataccttagactcttgacttgactttactttctcttctctgttataaaatctgctacattccttttcctgggaaagcgaaatagattatgccaaaagttctgatttttaaaaatgttttattgtgggccgggcgcagtggctcatgcctgtaatcccaggactttgggaggccgaggtgggtggatcatgaagtcaggagatcaagaccatcctggccaacacagtgaaaccccatgtctactaaaaatacaaaaattaactgggcttggtggtgcacgcctgtaatcccagctactcaggaggctgaggcgggagaatcccttgaacctgggaggcggaggttgtagtgagccgagattgtgccactgcactccagcctggcaacagagcaaggctccgtctc

SEQ ID NO: 49149 - DNA, 961 bp, Homo sapiens
cccttgaggaaagcccagcgacgccgggccagcgcattcttattttatgtatgagcaaactatggaatggaaaagagattatgagttattacttgatttgatttgccctaagtgttttttaaacgaagatctggcaagagttagcgtgcagttctacattgtgacaattcatgagagctaaggactggctgtctcttgggacaaataggctttcttgagtctgcatgaggccctcaccagatacagccacctgatcttggacttcacagcctccagaaatttcctaggaaagaagttgtttcaactctcattggaggaagtataaggtgatctcagggaaggggagaagggctggttgcctgccaaatctatgatcaagtcggctccacagtcactttgcttccacttctaagtgagaacatacagtgtttggtttttcattcctgagttacttcacctagaacaatggcctccagctccatccaagttgctgcagaagacatttcattccttttatggctgagtagtattccatgtccagtgattcaagtttgacacaccacaccacggtggatgtgccttgtcatgacacatcttctcagcagcactagaagatacatccaaagtcctgtgagcaaggacacagcgagaagatggctgtctacaagccaggaagagagtcctcaccagaaccaaaccctgctggactttgatcttggacttcccagcctctaaaactgtgaagacataaatttctgttgttaaacccacacaggtctgtggtatctgtttattatggcagcccagtaagactaagacaggccatcacaagacatgaatgttttggaccttctcttgggccctagtaaacagaaatcaggtacgcaaaaggggtaagcatataatttcctttatttttatttttaatgtgtaagccttaggtttttatttatttatttgg

SEQ ID NO: 49150 - DNA, 629 bp, Homo sapiens
cttttatttagaagacaacataaaaattaaaagagaaaaaatatcccccatattcataatacctctctatggactattcttttgtgggataaggtaggtgggagaatggaagagtagcagacccattagaatacaaaacatatgccctggaatacacttgtgtcagtgacaaatgctgctttgctgtgctacatcgagtacaagtccagtgattcaagtttgacacaccacaccacggtggatgtgccttgtcatgacacatcttctcagcagcactagaagatacatccaaagtcctgtgagcaaggacacagcgagaagatggctgtctacaagccaggaagagagtcctcaccagaaccaaaccctgctggactttgatcttggacttcccagcctctaaaactgtgaagacataaatttctgttgttaaacccacacaggtctgtggtatctgtttattatggcagcccagtaagactaagacaggccatcacaagacatgaatgttttggaccttctcttgggccctagtaaacagaaatcaggtacgcaaaaggggtaagcatataatttcctttatttttatttttaatgtgtaagccttaggtttttatttatttatttgg

SEQ ID NO: 49151 - DNA, 1014 bp, Homo sapiens
tgtgttactgttattcctggtaaatcattcagaagaaataaattttcttgccactcaaaattaactagtatggtgcattgctgccccaccccccaaaagatgagttgacagctactgggcattaatctagccattttttgataacagagtatctctttgcacatagttatgagagttataaacattccaaatgtaattatctcagtcctttacaacttggaagtctaattaaagaaagtttaagatactataaatcttaaggaattaggtttataatgtggaacccagtcagagtttgggattacattggaaagtgagtatattgaaaaggattgcagaaacatttctctcagccagaatttaattgctcagaaaactgaatttcagtaaaatagatgaaaagtggtaggcagagagactcagacctatgactgctgaagaaagagctaattccatatccctttttctagatgccctggaatacacttgtgtcagtgacaaatgctgctttgctgtgctacatcgagtacaagagaaatacatgggctatcttcagcacagaacacaaactctgccttcttttctcaagtccagtgattcaagtttgacacaccacaccacggtggatgtgccttgtcatgacacatcttctcagcagcactagaagatacatccaaagtcctgtgagcaaggacacagcgagaagatggctgtctacaagccaggaagagagtcctcaccagaaccaaaccctgctggactttgatcttggacttcccagcctctaaaactgtgaagacataaatttctgttgttaaacccacacaggtctgtggtatctgtttattatggcagcccagtaagactaagacaggccatcacaagacatgaatgttttggaccttctcttgggccctagtaaacagaaatcaggtacgcaaaaggggtaagcatataatttcctttatttttatttttaatgtgtaagccttaggtttttatttatttatttgg

SEQ ID NO: 49152 - DNA, 786 bp, Homo sapiens
  misc_feature (102)..(102): n is a, c, g, or t
  misc_feature (107)..(107): n is a, c, g, or t
ggactgctgctcggtgatgtcttgaggaaaaccgctagtgaggccgggcccatcgcattactgattctgattgaagcatcgtgtgccgtagcaggtttagcngtgcnagcttctagcattgttgagtgtgctatgatagcataatgactgggcgtctttttacaacgctaggcttcttgagtctgcatgaggccctcaccagatacagccacctgatcttggacttcacagcctccagaaatatgccctggaatacacttgtgtcagtgacaaatgctgctttgctgtgctacatcgagtacaagagaaatacatgggctatcttcagcacagaacacaaactctgccttcttttctcaagtccagtgattcaagtttgacacaccacaccacggtggatgtgccttgtcatgacacatcttctcagcagcactagaagatacatccaaagtcctgtgagcaaggacacagcgagaagatggctgtctacaagccaggaagagagtcctcaccagaaccaaaccctgctggactttgatcttggacttcccagcctctaaaactgtgaagacataaatttctgttgttaaacccacacaggtctgtggtatctgtttattatggcagcccagtaagactaagacaggccatcacaagacatgaatgttttggaccttctcttgggccctagtaaacagaaatcaggtacgcaaaaggggtaagcatataatttcctttatttttatttttaatgtgtaagccttaggtttttatttatttatttgg

SEQ ID NO: 49153 - DNA, 395 bp, Homo sapiens
atgtttcaaaagaatctgcccaaacatatgatctccatcaactgtaaagttagggcctggaatcacacctttcattttctttttgtctcctttagcagccctgaagagttttcaccaaattgcaaactggagtcaggtaataatgtttgtttctgagctttcagaggaagctgtttattttagtaggcaattttcatgtgtgatgaagtgaaatgttgagaaggcagcctctcatcagtggacaaacaatgcctaagaatttagctaatggccccccttcagtgcagagaatagatggtaacaattggacttgcatactagacccagagctacttgtttggctgctaggtgttaatgcaaatttgttcttcagctcattcaaccctggggctccc

SEQ ID NO: 49154 - DNA, 635 bp, Homo sapiens
tagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaaccca

SEQ ID NO: 49155 - DNA, 2542 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtaagcgcgcgccatggccgcgcccaccaggctcccgcaggaccagtgcacacaaatgcttggtttttatgaagagtaaacttctttctttgtaaagc

SEQ ID NO: 49156 - DNA, 6533 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattataggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggc

SEQ ID NO: 49157 - DNA, 6479 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattataggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggc

SEQ ID NO: 49158 - DNA, 4201 bp, Homo sapiens
cctccagcagaaagtctggaggggcgtatttcaacctaaaagtacctggccggttgaagtccatggacggctgtttgcagtcctgggcgcggtgaccagtggccccgcagttgtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattataggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggc

SEQ ID NO: 49159 - DNA, 5852 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattataggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcatgatgtacaacgagcaaggcataaaaaaaaaaaa

SEQ ID NO: 49160 - DNA, 1775 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataattagcccatcaaactgctgctgtcgtcaatctagttcctgctgattctgccatttctgggcaaacttcctgtcctaataatgtgcaaatgagtgtgccccctgcaaaaaagtgtgca

SEQ ID NO: 49161 - DNA, 6479 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgattcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattataggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggc

SEQ ID NO: 49162 - DNA, 5870 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaacctaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggc

SEQ ID NO: 49163 - DNA, 2867 bp, Homo sapiens
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccagaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtaagcgcgcgccatggccgcgcccaccaggctcccgcaggaccagtgcacacaaatgcttggtttttatgaagagtaaacttctttctttgtaaagcaaataatttttcgaatgctctttgaaagcgcgtggaaatcttcatgataggccgtgaggtccccagaaggactgctgttgggtctaaaacggccatgatgatttcagacagcctctggttctagaaggtgcttagccagtgtggacagggcctccctggactgccgtgtcctgattcgagcccagagaggcacgtgtgagggattcagtgctgccccctggcttaacactggggccctcaggctgtggcgcatcggcattccggaccttcggtagccactcacgtcccctttgactcaccctaccggtacgaccatgggtctagg

SEQ ID NO: 49164 - DNA, 388 bp, Homo sapiens
tttgggtttgtacatgtccattgcttcccgtgcaatcataataaccaaaagttggaatgtacacagtttttgatgtgtaactttctttttgtgttagaccctgattacataaataatgaatatgcacatttgtgagtatactaaaatttcaccataatgctgtaagtgatgttaaaaaaattcacgtacataaaaacaggatcatttgacttcaaggctaatgaaatggtcaggtgagccacatgtggtggataggagccagtcaccaattgcatggcttccaaatctctgtgatctaagagtttaattgtactactaatctgcttcgtttttgagtagctaccttatataggcagaggtgtacatatgcctcttagatgtgctcttt

SEQ ID NO: 49165 - DNA, 376 bp, Homo sapiens
ctcattgcctctggggaaatgctctgtaactatggccatagaagatttagtttcattgggaaatggagataatattaagtttaaatgaggtttactgagttttaaatgaggtttaaatgagtaaattcatgtaaagcacagagtaagtgctcagtaaatactaactaggagatatgaaagtaattattactattattcttatattccaccccttcactgcccagtatcaacctttctgcacataattataatctctgaagtgctctcatctaacaaaattaaagtgtctttatgcaaacaaaaatacactcgccccttctttaaagtctcaaagcccaaagagtttatacatctggctttaagtccaggctctggg

SEQ ID NO: 49166 - DNA, 1061 bp, Homo sapiens
tgtgggactattggtcatcttttcaacaaaaccagatattaacaatcaatgtcagttaaaggagagttgtagacttaaatagtgtcaattgtcctacattttcatgttgttgataacagcctaccatagaggtgttacagcttccaccattttacacaggaggaaacagagctcagctcagagaggttgagttttccaagaagccaagtcatggggccaagaatagtgcccgggtgccatgagactctgcccactactgccctgctggctgcagagcggctcagatacggctgtcatccaagccagggagcctttgagccagtgctgctgagaaaattgggaaaaagcccactgcccggttcccagcacatcttcactgttcctcgggctccctccatgtctgtttccctctgagtgtagtagattggggactcagaaccttctagaacagaagttatggttttgtaaggggaagaaatatggtcaagtgcacatctataatttagagtattaaatttccttgtacccttatgatttattctagaaggtcagcacattgattacaaagctaatgttggctaacattaatccttcaggtatgaggtaagaaataaaaaattactttcatgcttcatttctgcacaaaatttcactctggaaagatatttcatttgaaaaaaaaattaaaagttttactctgtaaaggattttcagatcttttctgctatgaaaattcttgttttctaattttcaaaatcttggtttgaaagtaattggaggctgggctggtagcttacacctgtaattccagcactttgggaggccaaggcaggtggatcacatgaggtcaggagtttgagaccagcctggccgacatggtgaaaccctgtctctactaaaaatatattagccaggcatggtggcgcatgcctgtaatcccaggttgtcgggaggctgaggcaggagaatcgcttgaactcgggaggcagaggttgcaggtgaaccaagatcatgtcactgattgcattccagcctgggtgacagagctagactctgtctcc

SEQ ID NO: 49167 - DNA, 2090 bp, Homo sapiens
gtttattaaagtatgtaattcctaaaatgcttattgaagaccttaaatctgattgttatttaaatttgtggttcagcgatattgtgttaaccactgatttcagagtagaaaaaatgcttattatttttaactttttaaagaaatggggaatgttttgtaacagtactcaaatagcacagaatatttttcaacattaaaaacatttgattgaatcctaatttagacaagccataacttgggaggatggtaaaccatcctctgaaagatttaactctttattggtttggaagtagtaaagtatacccctaaatgcctaggattagagaaataattttattcattgactctttatggaaaccaaatggtatctaactctgttccttctcagccaccttgaaggtgactattagtgtggtctttaagttgcttttagaaatcctgaagaattcagtcttcgtctatcatattcttcagatttccttttttgtttttgcagttctgaggccaaaagatgaagtttctttgccttgcctgatgtggcatcaactttctaatttttaaacatgttaccagcgcatgtctactgatcgtgtactgcaggacctgggtagacagaaacatacccacctctgccctcctcaccttccagtcagggcagcaggggatcctcatatcctctgaggcaaagcaaatggcttcactttatgtggaaatgaatttgccagtgagctttcgtgcttgtttgacaataaggcatcactgatgtgaactaatttggtggcaggtctcctctgaaggaaaccagaaattgtaacagcatggccaaggggtgtttctagggacccagtcccacaggtgcctaagggaagtgttctcctcccctttcaggaactccctgctgtgtggtgagaggctctggtggccttgcatggaagagcctgttgccccccagcttactccactgtggcgcacttggttggggttctttgggtaaagctaaatcatagatggtctttaaagaaatcgctttgcaagtgttagtccttcctgattggaagccttctccattgagccttattggaattagaaatttgcagtggttctcagtttctaggcttatcataatataagatataaaccaaaaagtatctgagacaggtctcaatcaatttagagagtttattttgccagggctaaggacacacctatgacacagcatcaggtggtcctgacaacctgtgcccaaagtggtcaagagtacactttgcttttgtacattttaaggagacataatacatcaatcaatacatgtaagatttacactggtttgatctggacaggtgagacagctcaaaggggctggggcttccaggtcataggtagatttaaacatattctgattagcagttggttgaaagagttattatctatagaaagcaatgtctgggttactataaggggttgtggagacctaggttttatcatgtagatgagcctctaagtagctggcttcagagagaagagactaaacgtttcttaccagacttaaagtgtgtgttcatgttcatgctggagggtagagtgaggaatgtctgacccccactgctcatcatggccagcaccagcctttcaggttaaattttagagtgccctggccgaaggggaggtccattcagatggttgtgggaggacttcaaattttatatttggtttaaaaaggagaaacagggctcagctggcatctgtactgattgatgtgcttacattcttcatgtggatgtggccagtgtcagcctggagaaaaaagaacgcttttagatttcaaaggagcagttgggtaataatgaactttaccatatttgcaaacctatctggtatctctcctcccttttcctttgaccacctattctgtctagggttaagaaaataacaaagccaattctggtttgtttttgtttttgtttttgttttttgagatggagtcttgctctctgtcccctaggctgcagtgcagtggcgcgattgcagtgaaccaagatcatgtcactgattgcattccagcctgggtgacagagctagactctgtctcc

SEQ ID NO: 49168 - DNA, 466 bp, Homo sapiens
gaaactatttttactctgcatgttctgttctaagcgtcatcttgagccttgcacatgatactcagattcctcacccttgcttaggagtaaaacaatatactttatgaggtgataatattttccatagttatttgaagtggcttgaaaaaggcaagattgacttttttgacattggataaaatctacaaatcagccctcgagttattcaatgataactgacaaactaaaatatttccctagaaaggaagatgaaaggagtgaagtgtggtttggcagaacaactgcatttcacagcttttccagttaaattggagcactgaatgttcagatgcataccaaattatgcatgggtcctaatcacacatataaggctggatggacttttatagcacattgcatttacagaaaaaagaatcagtgaatttaaagataaatcaatagaaattattcaatttgaagaagagag

SEQ ID NO: 49169 - DNA, 217 bp, Homo sapiens
acggggagtgttttaagaaatttgatttcctgatctaaatttgtatctttagacctttctgagaaccaaatagacttggaagggttgactgcatagactgctttttcatgctcactctgtcacaatgtggcaaatacttgttttccccaaattcacattgaaactgcctggagaaggaagttggtcctgaaaaagacgtgcctggcttcttatcctt

SEQ ID NO: 49170 - DNA, 1081 bp, Homo sapiens
cgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaacccaacacatttcagccaagtcctgctgatgtttctcctccgatctagctcctcctttccagccttacttctgccactccagatttcacccccatcagcttcagactggataaaaggaaaccatttctctaaaggatcacttgctctctcatttcaggccatcctgcagccaccagaaccttccacatgaaatgaaaggctcaccacttcataggctttaaggaaattcttggccaggtgtggtgcctcactcatgtaatcccagtgctttaagaggccaagatgggaggattgtttgagccagctgtttgagaccagcctgggcaacgtcatgagaccccatctccacaaaaaaaaaaaaaaagaaaattggctgggtgcggtggctcatgtctgtaatcccagcaattttggaggctgaggcgggtggatcacttgaggtcaggagtttgagaccagcctggccaacatggtgaaaccccgtcactactaaaaatacaaaaattagccaggcgtggcggcaggtgcctgtaatcccagctacttgcgaggctgaggaagaattgcgtgaacctaggaggtggaggttgcagtgagccaagatcatgctgctgcactccagcctgggcaacagagtgagactccatctca

SEQ ID NO: 49171 - DNA, 673 bp, Homo sapiens
cgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagagtcttgctcagtcgccaggctgtagtgcagtggcacgatctcagctcactgcagccgccacctcccaggttcaagcgattctcctgcctcagcctcccgagtagctgagactacagagcaccatggcctggcaaggtccgacgttttccaaggatcctggctgagctcctgtggaagctgcttcttacactgatgtggtccctcggctggcaggcccttctgcggccaaccaggtgacacctgccagttatgagggacaggtaggagaggatgggctttccatcagaaaaaaaaaaaaaaaggttttccaaactgcttttctttcaaattttaatcttaagactaacctacattaatttcttatttttatctcataaagtccagaatttctgataatttcagttcttttccagagtgcaaagaagcattggctcttcaggtattatgtttaacattttgcaggaattgctttactctatagacaaataaactacacatttaagacttat

SEQ ID NO: 49172 - DNA, 796 bp, Homo sapiens
cgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgccatcctgcagccaccagaaccttccacatgaaatgaaaggctcaccacttcataggctttaaggaaattcttggccaggtgtggtgcctcactcatgtaatcccagtgctttaagaggccaagatgggaggattgtttgagccagctgtttgagaccagcctgggcaacgtcatgagaccccatctccacaaaaaaaaaaaaaaagaaaattggctgggtgcggtggctcatgtctgtaatcccagcaattttggaggctgaggcgggtggatcacttgaggtcaggagtttgagaccagcctggccaacatggtgaaaccccgtcactactaaaaatacaaaaattagccaggcgtggcggcaggtgcctgtaatcccagctacttgcgaggctgaggaagaattgcgtgaacctaggaggtggaggttgcagtgagccaagatcatgctgctgcactccagcctgggcaacagagtgagactccatctca

SEQ ID NO: 49173 - DNA, 434 bp, Homo sapiens
cgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaaccca

SEQ ID NO: 49174 - DNA, 539 bp, Homo sapiens
gattaagtttgacctctgaattttctccttatacttcttcacagtgtttaggaccttgcatgtcctatttgaaaagtacaccctggagttgctatagatagtaagaaccagcttgcaacaattggagagtgttttttttgtccttaaagtaattctgcctcttgattatgtcttaggattggtttcacagagaagtggtcattccttcacagtgaatcacaaaatgagtagttttgacaggatttcctgactcagtctggctaactcaacctgctgttctgagtttctgtcaatattggcatgccaggagcaaactcttgacttggttgtcttgggtatacagataattcctaaatccataccctcattgctgacctttggaccataggcttgtttctaaccagttcctgctggataggtctatgtttagatcctgacatcaaagtaaaccataaggagttgagagtaactctgcatcttaattgcctaccagagcaccttatattgaatagaatcctataaatgtttgttgttaatga

SEQ ID NO: 49175 - DNA, 339 bp, Homo sapiens
ggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaaga

SEQ ID NO: 49176 - DNA, 415 bp, Homo sapiens
aagatatatgtaagtaatctcatatattatacccgcaatcaaaatgagaaatggcacatgagatccaggctctcaagagaaatattatgaaatctcaaggtattgatgaaagtttttcaaggctgatccaaatgggatttagattctgtggcagttgaaatgtgtattattaaactccttaagcaaacccgaatgactaccagtggaggattaagacattctatgtatagcaaagacgaaattctcatgtctgagttttctctcttgaattccctcttgattaggcttctgtaatatttaacttccatgccatgccataattatttaattaaaagggtaaatataaattattatttcagtgggggctatggacctttttaccttaatgtttattatttactaaagaaagacatag

SEQ ID NO: 49177 - DNA, 381 bp, Homo sapiens
ggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtcttt

SEQ ID NO: 49178 - DNA, 537 bp, Homo sapiens
tgaaaataccaaatcagttatttgaatatgcctaggattctaaaaccacagaaaataggcacattaatttccttagcctattactccctatggccagttggctacctcccaggtatcttcttattcttgcctgaccagcttaaccagttccatcatctgttcacatttgttcctcttcttagagcaacagagttaggtatacaagtaattaaataaagactaagcactaatgccctaatcccagctaattttaacaaggacactcaggaggataaagaatcaagaagagaaatattttttaaaaaagaatagaagtattatataacttttgttcttctaaacatcaaaatccagtcagaatggttatagaaaacattcaggaacagtgtctaagcaggaatagtagcaatttagtgagctgactaccagtgttctttctcataataattcccttaaacaactttgcattaagggagatgctgcaaaagcaaaatgatctttttacttagagtaggtaagtcctattggaatttaaga

SEQ ID NO: 49179 - DNA, 731 bp, Homo sapiens
aacagcactctgttgatcaagcaaactttctaggggccctaatccacctgggcctgcagtatgtaattccataactcatgggatgccatcaagagagacaatctacttgattgctaaagggcctttgttttctttggagttccccaggaaggagaaatgtatgtgtgtgcaggggtgaggaggggggagagtgaagaaacaatactatgcccttaaaaatgtttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatgtattcaaaatactgattttttaaaagtatgttccttggagccctgggaacctgcctcaggagctggggtggctgtggggagtgagtatgaagggagctgaatgagttagtgagaatctgggtcttcatatcttttttaaaattgtggctgcttttttctgttctgtataacaactctttttgaaaacagtttcattgttgagttttaaaaccactgacctaaaataaccaccaatttaacgtaagtataacttcattgagtttttttgtattaaaaaaattaaactccattttcttcatggattaaggtgat

SEQ ID NO: 49180 - DNA, 198 bp, Homo sapiens
ggtccccacctcccagtctttgtcaccattaaacagtagctccaggacagggcagcattgcatagccctgcccacacccattctgctcatctgaccaccactcaatttcctaccaaggactggccgactactcagatgccagaccaccaagacaaatgtggctctgttctacaaaggaacagaaagtgaatgtttctt

SEQ ID NO: 49181 - DNA, 836 bp, Homo sapiens
cgaattttgagtctaagagactattcacaaagtccctaaatgtctgagccactgtaattgtgtgtcataggcatgctgacagcctctccaagttctgtctccagccacagcagtgtccttgcctggaccacctctcttccctgctcacccttcaggacctctgcacgtcacacccgtttattctgtaaatgtttgctgcatgtgactccatgccaatcatcatggtgggttcagatgatgccacctccagccttcaaggaagttacagacaagtatgttcagaaaaacagggcaaactcacacagaaaaatgggcagtatgtgaataaacattcactaatcaggtcccttgggcctgtcctgtgctgggtgctgaagaaagatgatggagacaaaagccctgactttaagaagcggatgctagggctctggtcaagggctgcatggtgattggaaacacatgggcacagtgcaggggtgctgcaccacacaagtccaggactggatggagtggcccctggagttggtaaatgcagctgctggagcagctgggcggctactctgggacctgagtgggaggctagtgatccaaggcagcttagcagcactcgtttatgtgaagttaaaattccactccagctgtttatccagtccacatgaggaagcaatcctggaagaaggtgggagggataaggtggagatttcttgtgaattccacccaaattacaaccagaggcaccccacttttccatgtgctgtgtagaaaggaccacatttgcattaagtctttgatgtgggtaagcctttcagtctgaattcatctgcaatcactaccca

SEQ ID NO: 49182 - DNA, 427 bp, Homo sapiens
attatagaatctcagcatttttgtcaaaaaatttctttttgatgattgacagatcaggagacacttaaggccatacctgctttcagtaatcaaaaatgcatttaagatccagaaacttgaggtagcagaacatcactatcacatataacatatcctttggtatagaaaattatattcccagagtgagtttcttttttaaaaccattaatgaggccaaggtgggaagatcacttgggaccaggagttcaagaccagcctgggccagatggcgagaccctgtctctacaaaaaattaactggatgtggtggtgcactcctgtagtcccacctactcagaggctgaggcaggaggatcccttgagcccaggaaattgtagtggcagtgagctatgatcatactactgtactgcagtctgggccacgaagt

SEQ ID NO: 49183 - DNA, 539 bp, Homo sapiens
aactcaattgtggtgagtgcttcacaatgtatacctatatcaaaacaagttgtacacctaaaatatatacaatttttcttgtgaagtatacctcagtaaagctcaggggcaaaaaaaagagatgagtcgatgttaacccaaactgttaaaaacagatgtcacctagttgaagctgcttccctatgtcatcaaaaggattaaaagagaattgaagaaaaagagcacttcaggaagaacaaatgataggctggaaacaaatacacaggggcctctagaagctgtgcctcttgatgaagaaggaatccctcgaggacaggagaggagctgggatgacacttgtagctctttgtgctaaaatgactcaggcagctcctgcattcattttgggtgctgaagttttagaactgttttccccacccccaccaacaccttcttatccctcctcctgggtctttcttagacttctcccagcaaagcagagtccgtatcctagtgtgttgctatggaaagaatggcaacatcacttgtgagttcatgaa

SEQ ID NO: 49184 - DNA, 286 bp, Homo sapiens
catagaggaaactttctgccactcttgagactcaaggaagaaaatcagtgggttcaggaggggaaggaaattgggggttgagtgctgtctaagaccacttctgttttgtttgctctcctccccttcaattcttcactttgaagcctagggaacagagcactgctcgttctttctgtcgatgtcacacagatagacaaccagaaaacagtgtagatgagtaggcttagattgggaatctaccagtcaggctgaatatgaaacctgggggaaacatattttacagaca

SEQ ID NO: 49185 - DNA, 426 bp, Homo sapiens
gtctttctctcccaggcactgcacacttcactaaaggccctggatagcaattgtttctaagataaattggacagttcctcattaactatgaaaggcctaaatgctgatcacctcaatcattatgttctaagctctcatcattagaaaaagaaataatcaggtcagccaaacctgattcttttgatgaaaatgtttccttctttgatgcaccccaggctacacagttccagttgcctgtgaactaagtactttctccatcagtgacacaatcttcatcttaagttctgaactcacatccattgctggtcctcccagcagctgtccaaggagccagtgggagcttctgtgctcttctggggtctctcagtagctcagagcatagatacaactcacccttctctccatcactcagcagacgggctagcc

SEQ ID NO: 49186 - DNA, 215 bp, Homo sapiens
cccccaccccgcccagcacacagtaggtgcccggcactgagtgggcacttgctctgccgtggtgccggcgcccactgctgtgactgcagcacctgccggtggcctggtcagcgtgacggtgaatgttgcaggtggtgttgccatgttggtgagacggtgtcacctgaggacatgaaggagctgcttaatgcgcccttgactttgtttttagagaa

SEQ ID NO: 49187 - DNA, 403 bp, Homo sapiens
tactggaactaataagcagttataacaagtttgcaggatataagattaatatgccaaagtgaaaagttttcctataaatcagcaatgaacaagtggaatttgaaattaaaaatacattactatttacgttaacacccccaaaaatgaaacattgggtataaatttagcaaaatatatacaaaaggcataggcagaaaactatacaactctgatgaaagaaatcaaagaagcactaaaatatgaagtgatattccatgttcatgtacagtatcgtaagactcaatattgtcaagatgtcagtttgtcccaacttgatacacagattcaatgcaagcccaatcaaaatctctataagttattttgtggatattgacaagctaattctaaagtttatgtgaagagg

SEQ ID NO: 49188 - DNA, 520 bp, Homo sapiens
tgcagtaggtctagatcaagtcactgcactccagcctgtgcaacaaaacaacagagcaagaccctgtctcaaaaaaaaaaaaaaaaaaagggtaagggtgctgattcctgaggcctagcttagactcatcgggaatctctgagagcccaggaatttgcatttttaactctattctcccatatcctgggtttagagaagtgctgccattgtggtggtcagggtcctccctgctgcttgtcacagaggccactgcggggagaggaagctgggacacccccaaggcccttctctggagaggggcctcaccttcaaaaaggctccggttgttgcctgatgctctgcacagagctgtaagtccgcagcccatgcacttctgtaatctgctgggtgcctagttatctttcttcttgtttgggcagaatccgggcctgaatgccacccaccccaggaagcccaggacaaggcagacagccttgtaaagtcccattcctgccaggcgcggtggctcatgcctgtaatc

SEQ ID NO: 49189 - DNA, 636 bp, Homo sapiens
gccatcctcctgccttggcctcccgagtagctgggactacaggcgcacaccaccatgccaagctaatttttaaatttttttgtagagatggggtctcacttttgttgcccagggtgctttagaacccctgggctcaagtgatccttgacctcccacagtgctgggattacaggtgtgagccaccgtgcctggcctcatgggttttctttgttttgttttgttttgtttttgagacagagtctcactctgtcactcaggctggagtgcagtggcacgattttggctcactgcaacctccaccttccgggttcaagcgattctcctgcctccgcctcccgagtagttggggttacaggcatgcgctaccacacctggctagttttttattgttgttgttttttgtatttttagtggtgacggggtttgctctgttggccaggctggtctcaaactcctgacctcaggtgatccccacttcagcctcccaaagtgctgggatgacaggcatgagcctctgcacctggcctcgtgttttttttttagttagccattttatacgtgtttactgaacacctgtcctgtgcccatattctaagtgccttacctgcattaaactcatgtaaccttcacaacccg

SEQ ID NO: 49190 - DNA, 799 bp, Homo sapiens
  misc_feature (639)..(639): n is a, c, g, or t
gccatcctcctgccttggcctcccgagtagctgggactacaggcgcacaccaccatgccaagctaatttttaaatttttttgtagagatggggtctcacttttgttgcccagggtgctttagaacccctgggctcaagtgatccttgacctcccacagtgctgggattacaggtgtgagccaccgtgcctggcctcatgggttttctttgttttgttttgttttgtttttgagacagagtctcactctgtcactcaggctggagtgcagtggcacgattttggctcactgcaacctccaccttccgggttcaagcgattctcctgcctccgcctcccgagtagttggggttacaggcatgcgctaccacacctggctagttttttattgttgttgttttttgtatttttagtggtgacggggtttgctctgttggccaggctggtctcaaactcctgacctcaggtgatccccacttcagcctcccaaagtgctgggatgacaggcatgagcctctgcacctggcctcgtgttttttttttagttagccattttatacgtgtttactgaacacctgtcctgtgcccatattctaagtgccttacctgcattaaactcatgtaaccttcacaacccgcgngtggaaaattatttaggatcaattaactggttaaaaaaaacttgggggggggcccggcacccaataccccttatagtgagtttattacgggccctactggccgttgttttaaaacagggttggtgggaaaaaaccctgcgtccaccaacttaattggctt

SEQ ID NO: 49191 - DNA, 428 bp, Homo sapiens
gattccagggaaagctttccaaggaggttttactggcattccattttgaagaatgagtaggagttaattgtttaggttgtttttaaattgcttatctcctaagtagttttaagaagaatgatattttgaaattatcttgtcacgcacaattctgtaggtttgatcaaagaagacagttcttatttctcctctttccatctaacgtacatgcattcacactcacaagtttggtttttcaaatgtgtggctttactatcagatttattggtaaaactatattgatgtgtatgtatgtgtgagaatagatggtaggaattacgtataagatcatcacttcaatgtaaataaaatttaccttctaggccggtcgcagtagctcacacctgtaatcccagcactttgggagggcgggcggattcagaggccga

SEQ ID NO: 49192 - DNA, 517 bp, Homo sapiens
acaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgaga

SEQ ID NO: 49193 - DNA, 351 bp, Homo sapiens
tccccttctgattttaagtgaaattaaaacgtttttatgggtccttaaaagtattatggtctgtaatcactgtgcctattgtacctactggggaagttggcctagtgtttgggtctgtggtgaccttgagtgagctgactgactttttgggcctcagttttctcatctgtaaaatgggtatagcaacagcatctgttttaatccgtagcaagtgactagcagagaggcagctttgtggctgttagtatctagttagggctcaatcagtaaagctatctacactaccttctgctggggggtgaggggcttgtgcgtggagggggctgggcttgtagtggagaggggctgagt

SEQ ID NO: 49194 - DNA, 433 bp, Homo sapiens
cagtggtagcacgtctttatctgaataaatactcatttgctgaactcacatttactgcatcttttaggggaaaggaatgagagtgaagtggcagccttgggaatgacatggctacccaccacatcagcaactgtgtcttcttaaagttgtgtgctcccaagccctcctgaaatctactcctgtcacctaacttccagatccagaactggtacccaggtatgcaatgccccgaggtgtgtgtctgaaggaagagcagtcaccataattactcagttgtctgcatttctaatgatggctacttatttgtcagtctgagaatgatcatatgccttgattgtagtcacaggtattaaatgatttttgaggatctgctataaactgatattgtgtgaattaaacagaaaactaacttacttgagaaaacaagttggta

SEQ ID NO: 49195 - DNA, 240 bp, Homo sapiens
tagaatatttgtttgagtgtgcacatttatacctgtttagtatttgattcagttaagcctccactcttctggatcaggaggtgattctgaacctgtggttctaacatatgacttaactgtttagagggaagagaagtctttctatactgagggatttgttaaaatcataaatgtttttgccctgagacttagcccagattctattttttttttttttttggcatttgtacattaagcacc

SEQ ID NO: 49196 - DNA, 786 bp, Homo sapiens
catgtccacacagaaaacctgcacatgaatgtttatagcagctttactcaaaattgccaaaaattggaagcaaccaagatgtccttcaataggtgggcggataaagaaattgtatccaattctatttctatgaggaaaatctattcatacaatagaatactagtgtcagagatttttttttaacaaagagctatcaagccatgaaaagataaggaagaactttaatgcatattggtaagtgaaaaaagccagtttgcaaaggctagatactatatgatcccaactgtataacattctgaaaaaggcacaactatggagacaataaaaagaacagagttttggatgaagggagggatgaacaggcagaatacaaacaaattttagggcagtgaaactattattatgatactttatggatatagaatattatgcatttttcaaaacacatagaatatacaacatgaagaatgaatgctaatgtaaactctggatttttattaataatattatttaattaaaatgatttattttacttattttcattattatctaaaatgttatttaattattaaatttagatgctacttaatttttgctttattattattatgttaatatcatcaactgtaactagtgtacaacactaatgcaagatgttaataggggaaatcgtgttggagagagagatatgtgagaactctgtactttcttttcaatgtttctgtaaacataaagctgctctaaaaaattaaatctattaaaaaaaaaactgagtggaaaaaaagc

SEQ ID NO: 49197 - DNA, 309 bp, Homo sapiens
aaaataagtattactatgtcaaaaaagtcttacaaatcatgcttctagttgccatcttaaaaattatgtgatgcagtgtgctataaatgtgatttagtatgtaatttgcctgggacgggggagaagctacatttattggcattgtggatgagctggatttatattactgatgttacctttgaaaggtatatgaatatttaatgataagatttttctggttgtcaaacatttgtaaatctgcaaacttcttaacaacattacacagtaaacaaaaaatacttcctgtatactaaggaagacttctaagga

SEQ ID NO: 49198 - DNA, 448 bp, Homo sapiens
  misc_feature (237)..(240): n is a, c, g, or t
  misc_feature (243)..(243): n is a, c, g, or t
  misc_feature (313)..(313): n is a, c, g, or t
  misc_feature (390)..(390): n is a, c, g, or t
  misc_feature (431)..(431): n is a, c, g, or t
tttttagaaacctgatgtgaaattacctgaaggaatgaagttagtgtgcttttaagttaagaatatcttcactcagtatccatggataggcttcagggaatctggatctctttgaaattaaagcaaaagtttggatgtatttctttttctggaggaaggatccattgcctttatgagtatgtaacagtccagaagaagttaataaaatagctcgaggctccgtctcaaaaaaaagannnnaanaaaattgttttagcgctgggtttcccaaggtgggagagacagacccagcctgggagctggcccctggctngtgtgctgacttcttgggggtcctcaaaccactgtatttttactgttgagcctgtacttgggggagagtccagttgncttttgagggaagttaaggaggaaaagattcctgggtaccnccagggttttctttgcc

SEQ ID NO: 49199 - DNA, 1184 bp, Homo sapiens
caatgtgcaaaaaaagatttttctttttgcagattttgtgtaaaaataaggacagtgtgaaaagtttccctaaaattgcaacagacatttgagaaaaagagagaatggaaaattctcaatccagtcaatgcaaaggagtcatacacaaggccaatgattcagggagggctccaggaaggacaggattaagatgattttaggctgatgaagactaatgggaaaacactgggtcccaagatatccgagtgaaatcagtctaataaaatgacattggaagacttctggtgacttatgcaaagccactgggtttaacaaaagaggcagagtggaagggcacgaggacccaagaggatatgccactggtttcctcatctgtaaaatgaaaggtttagctttgttgcttgacatgatttacttttcccattgttccacctgaaaatatagtacttaaaaagtgttacaagaaaaaaagatgcataatctcacttcaaattttacaaaatccttccacatgcaattgaaatagctacagaattttatcaactgcagagtcagagatggaaataaagatcaacttcaaggctcttatttttaagattaaaaaactcaaaatttaagggacttgttcttggcaaaaacttggcagtcaggattcagacctactcctcctgcgtaagtgagtctataaccctccgtataccacagtgcccacctaaatgagtctgtaaccgtccctataccacactgcccatccaggcgaagtcccttctcaatctgggtgccctctttcagttcccttcacatcctcaatggggtcatgtccttgatgtcaggagtcaggatgacatcatagagctggactagctagaaaattattctacggttaagaatcagtcaaggagaagaaaaaaaatttactcactgcaggaaagcatcatattatacatgttagctctctaacaaaaaccacagtacatttagattgaaggaaggaacaaattaccagtttgaaataacagacaacttggtgttacaatacagctaccattccctgggatacacaagctgaactgctcacagcagcttcttctaaccttttcaaaggatggaagatcatctgacaggcattacattatttttcagttttgaagttgttatgaatattaaatgaagcagccttttga

SEQ ID NO: 49200 - DNA, 1829 bp, Homo sapiens
  misc_feature (402)..(402): n is a, c, g, or t
tgagacagaatctcgctctgtcgcccaggctggaatgcagtggcgcgatctctgctcactacaagctccgcctcccgggttcacgccattctcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttgcctggaaatagatatcccactggggatagtggtgtgtaaactatgacttggacaattctatatactcaagcaccataaaaagtatgcagttgaaaagaaaatcaaagttgantcctgggtgccaactaaatattcaaatcaggtactcatccttatcagctaaattcattttcaccaggaacagaccaccaaataaattattttatcctaataactagttttgaagcagtgtaattactctggaagaaggctctaaaaagtcatgattcccccactattttgaaatgtatcctctaacaaggatcattatagtgtaatcttaatttttatgtttatcaagatgaaatcttgtttgaattgtgatattataaaaggggactcaaaaatccaagcagtctactgtgtttaaattaacaccacaaccttccttatcagattataagagtagaaaaattaacacttggtgtgtgaatcttcaggaaaatgagctatttcataagctcaaacaagcagcttccttttccagagaatatagaattatattatggtctccttaaatgtttagtagctcttatggtcacagcatttttaatctccctatggcatctttatggaataattttctaaagggtaattctctactaaaaatatcagaccccgaccatatttaatgtggagagcaataccctcttagaaagaaaatacattgactcatacacttgttaaaagttaataaagaaatagctcatttttaaagccggaagtttatggtctctgcatcgtcaatttaatttaagcattgctgagacaatctttaatctactcccctttttgtaataccttatttatggtgcattttcatttttatttgggggaaacgttagcccaacagagccggcagatgaaagtgttgaaaagaggtcaaatggaaacaaaggctcttacccgctgtatttcagacaggactgaggcacttagccgaggagccactgggttattagattaatttcaaaagagcttttacaagttgcttaattcctttttttttttttttttcaaaaacccatgaaccacaaactcaaatttctcctcaaatggggttaatctgacaaatgaggcatggacccagccttgtggaaaaagcattccacgctaatgagatcttggtctttcttgtgaggctacgttatttatgtaaatatgtctggaggcaccttctctaagcttttagttttctatgatctattagtttagtgtttattaaagaatcaaatgtatagaattaccaggcattcgtggggaatgctgtgtagcaaatgtaaaactgacctgctcggaagaaacgtaggaacgcttcaaacccactgtaatgtttggtttgagattattttcattgctttgagagtgaactgcctaagagtaggccttataataaatgctatgtgcgtcttcagtagttccaagctaaagcaatttggcattctcccactgtgatttgtgacttttaaacccacaaaataaaagctttttggtattgat

SEQ ID NO: 49201 - DNA, 2302 bp, Homo sapiens
  misc_feature (402)..(402): n is a, c, g, or t
tgagacagaatctcgctctgtcgcccaggctggaatgcagtggcgcgatctctgctcactacaagctccgcctcccgggttcacgccattctcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttgcctggaaatagatatcccactggggatagtggtgtgtaaactatgacttggacaattctatatactcaagcaccataaaaagtatgcagttgaaaagaaaatcaaagttgantcctgggtgccaactaaatattcaaatcaggtactcatccttatcagctaaattcattttcaccaggaacagaccaccaaataaattattttatcctaataactagttttgaagcagtgtaattactctggaagaaggctctaaaaagtcatgattcccccactattttgaaatgtatcctctaacaaggatcattatagtgtaatcttaatttttatgtttatcaagatgaaatcttgtttgaattgtgatattataaaaggggactcaaaaatccaagcagtctactgtgtttaaattaacaccacaaccttccttatcagattataagagtagaaaaattaacacttggtgtgtgaatcttcaggaaaatgagctatttcataagctcaaacaagcagcttccttttccagagaatatagaattatattatggtctccttaaatgtttagtagctcttatggtcacagcatttttaatctccctatggcatctttatggaataattttctaaagggtaattctctactaaaaatatcagaccccgaccatatttaatgtggagagcaataccctcttagaaagaaaatacattgactcatacacttgttaaaagttaataaagaaatagctcatttttaaagccggaagtttatggtctctgcatcgtcaatttaatttaagcattgctgagacaatctttaatctactcccctttttgtaataccttatttatggtgcattttcatttttatttgggggaaacgttagcccaacagagccggcagatgaaagtgttgaaaagaggtcaaatggaaacaaaggctcttacccgctgtatttcagacaggactgaggcacttagccgaggagccactgggttattagattaatttcaaaagagcttttacaagttgcttaattcctttttttttttttttttcaaaaacccatgaaccacaaactcaaatttctcctcaaatggggttaatctgacaaatgaggcatggacccagccttgtggaaaaagcattccacgctaatgagatcttggtctttcttgtgaggctacgttatttatgtaaatatgtctggaggcaccttctctaagcttttagttttctatgatctattagtttagtgtttattaaagaatcaaatgtatagaattaccaggcattcgtggggaatgctgtgtagcaaatgtaaaactgacctgctcggaagaaacgtaggaacgcttcaaacccactgtaatgtttggtttgagattattttcattgctttgagagtgaactgcctaagagtaggccttataataaatgctatgtgcgtcttcagtagttccaagctaaagcaatttggcattctcccactgtgatttgtgacttttaaacccacaaaataaaagctttttggtattgattgtttttaattaaaaatacttccaagtataaattgaaacggatgccacccttgaagatttactggcgggaatgctcactcttgtcgttttcctcagtatcgttcatgtctttggcaacaagaacacctgatgaaagcaagcaatgctcagttcccatcaacatttctagttagggggattctcataaccccacagtttacctgagaaagttttctgtgttagaagaatggggtcgagagtattaccttttagctcagtgtggccgggccttttgttgcagtcaaatggcaaatacgcactccttgaaatggcttcttttatttggttttgttttcttagacttataaatttgaaaagaatgcaatttaaaaagtgatttctcacaaagagtaaatatgccttttgcaaatcaatttttgtaacaagttatttatatgatattacttaataaactggtttttttctaaacttgc

SEQ ID NO: 49202 - DNA, 768 bp, Homo sapiens
tgaaaggatattttaattacgcaataaaaagaaatgccatttatggcccaacagaataatttttttttttaaagacaatccttggtattagtgagaagtactgggaaatggagatgttcctgtttctttttagagataagttttcgtcatgttttcctgcatgttaaagatttattggaggaatgttcttcaggttgtttaataatagagcacttcatcgttaaaagggaagaaacaagttcattcgtttggtagacttttatatttattgaagactgttacataccagtcactcttatagcgtagttgaagtgggatatgagtagtcagatgttactctaaagtatgatagagtgagtcccgaaagatggaagaatgggaaatataggagacattgcagggggcactccattggaggcagtggttttgggagaggccttgagaccaaagggaatgtggagtgtttggggagctgctgcggtatggagaggaaggggttcatggccgtctcgaagggctgtgcccacagtatggaactggaactgtgtgttgaaacagtggagagcctttggaggattttaagcatggaagtgatgtattcaaacttgctttgacatgctgaggttcataatggactggctcttgaattaacagggaagtccacactgcaatggagattactaaaactgacatggaggatcctgaaaaagaaaaactttggaagacagtctatttttaaaagttcccaggaaatgcaaaggaattaag

SEQ ID NO: 49203 - DNA, 302 bp, Homo sapiens
atgatgcttataacactgttgacagtataggttcctaagagaacagagctagaaagttaaccaaaggtcaaattctcatataaaaggaaaaagggtgttttttaaccctttactcataaagaataaatgagcataatctctttttaagatcacatttggacagtaaacattgaaaacttttattgtgtgtgtaccctttcaagctggcaattttgttttcatggctttattgtaacaaatacgaaatatgcacaaagatgtgtctgtgtctatatgtaagtaggtttattaagcattatttg

SEQ ID NO: 49204 - DNA, 435 bp, Homo sapiens
aggggggagtacattcagtaaactgtccctgttaaaatatttaatagaaaaggttatgtattcccaaagaggcaaggtaatctcagaaattaccttaaaattttggcacagtagaaatgtgaacacactttcagagttttcctaatgaaaggtaaacctgcttttgtattagaaatgtctataacacttcagaaatgaacaggtaagatgtgttggagccacttaaaggcagttcagctctatggttctcatgacagcttaaagagatctcagccctgaacacaatccccttttccttccagagcttaactacagcagtgttccttgctcactccccatgccttctttccactgggcagaagaaagcaagtgtgggagaaaggcgctccgcagtcaccctaacatgaaggggcgggcagagaggatgcttccggg

SEQ ID NO: 49205 - DNA, 1653 bp, Homo sapiens
cttcctcccttcaggaagtttgaggctgagacccgaaaagacctgggtgcaagcctccaggcaccctgaagggagtgggctgagggctggcccaagctccctcctctccctctgtagagcctaggatgcccctctgctgcagcggctcctgagctcatggagccctcagccaccccaggggcccagatgggggtcccccctggcagcagagagccgtcccctgtgcctccagactatgaagatgagtttctccgctatctgtggcgtgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccggggccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaactgtgaag

SEQ ID NO: 49206 - DNA, 1467 bp, Homo sapiens
cgcagttgccgcggatcgtgctgagccccgcgagccgaggcagcgcagcctagggagggggctgccccggccccctcctgcagtcccggcccctagaggctcggccttcctcgcaggaaggcgaagtccccggtgccaggtccggggaccagcagccgagaacgcccgggtcccggagccaacaggctccgagtgccctcgctcccccgcgccttcccggagccccgccagcccccgaggtgcaggaaggtcccgcggacggagcgggcctgccggcgttcagtggggttcttggtgaagcacttggcacgcatcggagctcattactcctcatcgtggtcctgtaaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccggggccgcgccttcctggctgaagtgaagcagatgcgtgcacggaggaagacagccaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctgagcgagggctgccctggaggctccggctcgggggatctgcccctacccctcatggaaagacagctggatgtggtgaaaggctgtggcttcagtcctgggtttctgcctgtgtgactctggataagtcacttcctctgtctgagcttgtgtcccctaagcagggttgatgtgaggattaagcatgctgaagcaagtggaaagctccttgtaaactgtgaag

SEQ ID NO: 49207 - DNA, 467 bp, Homo sapiens
ctccccatccgtgtggaactgtgagtccattaaacctctttcctttataaattacccggtcttgggtatatctttattagcagaatgagaacagactaatacatgtggtttacaataacataataaccttaattatgattgatagcatatactcagacattagaatggtagacatcctatatgattttaaaacacatattaatattattcattaaaatataacctatggaagattaaacatcactttggcaatcctctgtaactaaacatgtcaaataatcctgtttacctctctcttggatgctctaggggtcctctagcatccaaaagctaggggtcaggaaagacaatttttgaagctgaagtttgattttgggaaatatgttaaatatatatgttagaggttcaaaagcatgtgatattatggaatagaattccagattaccgtaagttcttttgccaaaatg

SEQ ID NO: 49208 - DNA, 157 bp, Homo sapiens
aagatactgagtttataaagcacgctgaagtcaaggagctggagatcatcccatgggggctgtccagagagacacacggatctaggtagaacaatgcaggtgtcaacagctcataatggtagaaggaaaaacccagcagccaaagtgatgtttttgt

SEQ ID NO: 49209 - DNA, 449 bp, Homo sapiens
cttgccctcagccccagtggccactggcaaagactgttatttcccaatggataagagagcctccttcatcttcttggccatagttgggatgaggtgcgtgtggtcatccacacacttggtcacacaaccgtccagctgctgcttcacctgaagctccttactcccagtatccattgaatctttggctttgttgttgcaatgcatggcgcaccgggccaggtggtgccggaacttctccaactcactggtgagcaaagcccgggcttgagccagaggcacatggcagtgctttgatgtactggtgcacctactgcatggaggcctggctgtcctcacaacagctggtgctgcaccggaacatgagaccctgcatcttccagatgttctctctctccagactcttcaccatggagtccaccacctcctgcacccacagctgctgcagctct

SEQ ID NO: 49210 - DNA, 715 bp, Homo sapiens
tctttggtttctgtggtttgaaattggtgtgtaaatagcataaggggacatgcgctcttctgagcttgagcagctggtcacattcttatctgccacttgtgttcccacttcatctggcccagtagctcacaaagggccactggagtgatcagtgaaggggggtgcctgggcggctggcctgatggggaggctcctcctgcagatgccacgttaataagtgctgcgtcctgctacggcactggggatccaggaggtgagtccgaaaccacattggccatgccctgctggatatagtgcacacagggcatccagggcaagacagccagggaggagaagggcctgggctcggcctctccagcccctccatgagctcacctgcttactcatccaaccccatggaaagcgatgcatctggcactgccaggaagataaaaaaagaaggaaaatcctgccttcggtgtctaatgcgggagacagagtccccagtaactgtactgtgagagaatgtggcctcagccattagagatgggcccagcgaagggattcaggagttcaacagaaggaggctcccacccagatccagaaaggctgcatgggggttttggggagcctagaactggggaggaagttctgggtagagggactaagggtagaggtcccctaagtgcaggagccaggtgggaaagtgaccagctatttcagattgcggtgtttg

SEQ ID NO: 49211 - DNA, 344 bp, Homo sapiens
gaagccatgtctgaacaaggcaataacatcccctcttattccaaagtgcctctcttgtaaaactcaaacttaacaagaggctttggattcctctctcagttccttgtcttaacaggggaatacatcccatgtctaaccagaatgtttgttgcttctggagtcaaacatatgcgcctcctaggcacagccattaacgtgggtgtttcttggatggctcagacaaccagagtttggattttaatggctcttttcacctctcttctccctgaggccatctatctaggagaaatctcacctatgtatgagaggcagaaaaaggagaaatactgaaataattgcatttt

SEQ ID NO: 49212 - DNA, 534 bp, Homo sapiens
ctccgatttgttcctagagcccctcccccagcagctaccagtctagaaactgtgtctatggatttgcatatagtggatattttatataaggtagtttagtgtctagcttctggtccacttgtactggtgttgactatgtatcagcccagcttatgtggctacagggattctcgttgcacatctgaatgaagccaaaaacatacgcaaggttttaagagtatttgatgtcttattggcaatatgaggtggaccagccatacagttagtaacataaccagcattggcttctggcacttagttctgagttctttccgaagaacttatatatgcagaaactggacttagcactcacttaaagaagaaataactttgataagaaccaggtgggttgttctttctctttattggtttcatgttttcagatcttgctaactctccccagctgtgccctgcagtgggagacctatttgagactctgttatgatatgcccaagataccacacatgccctaggctctttcccctaggcgacaac

SEQ ID NO: 49213 - DNA, 268 bp, Homo sapiens
ttcaggtgtaaattttattgccttggataaataaattattgatcttttttaaggcagcagttattaaattggtaatagaagatgctgcttgcttagaattgggaaattcggctgggtgcagtgactcaatgcctgtgatcccaaagtgctgggattacaggcgtgagccaccgcacccggccaggatgggttaggtttcaatgtaccacagccccagccctcacaccttcatgaggttctgctccatgtaggaggcgaagtaccgcag

SEQ ID NO: 49214 - DNA, 917 bp, Homo sapiens
ttcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtaagggtatcttaattatgctcatttcttcccctaaaccacattatctatatgattggaccctttagtgaaa

SEQ ID NO: 49215 - DNA, 1329 bp, Homo sapiens
tggcatgatcatggttcactgtagcctcaacctcctaggttcaagcagtcctcccacctcagcctcccgagtagcgggactacaggcaggcaccaccatacctggctaattcttttgtattttttgtagagaagggatttcaccatgttgctcaggctggtctcaaactccagagctcaaacagtctgcctgctttgacctcccaaaggactgggattacaggccacctcacccagcctttctcagtttttgaatagaaacatctatttcaaattcatttttaagtatattttgtgaatataggattacaggttgacacttttttctttgaggaacttcagaatggcactccattatcttctcacttccatcatttctgttgacaagtgattttcagtgctattgtttctcctttgagagtaatgtgtcagtaacatgcactggctcacgcccgtcatcccagcacccttgagcccaggagttcaaaaccagcccaggcaacagagcaagatcccccccctctacaaaagaaaacgacaggagggaggcaggaaggaggagagagggagggaggggaaaagaaaaaagaaaagaagaaatgtgtccctcctacctgcctctagctgcttttactgttttttccttgtctttcatttgcagcagtttaagtatagtgtgcctgggttgggtgcggtggctcacgcctataatcccagcactttgggaggccaaggccagtggatcacctgaggtcagaagtttgagaccaacctggccaacatggtgaaaccccgtctccactaaaaaatccaaaaattagccaggcatggtggcgcgtgcctgtaatcccagctattcgggagactgaggcaggagaatcgcttgaccttggggaggcggaggttgcagtgagctgagatcgcgcgccaccgtactccagcctgggtgacaaagaaaaactccgtctcaaaaaataataataaaaaaaaagtatagtgtgcctggatgcagttttgtttttatttatcctgcttggggatcataaagctttatcagttttggaaagttctcaggctatatttatttaactgttccttctgccccatcttcctcccttctaagactccagttacatatgtgttaggcctgttcaccacctcccacaagtatcttatgttctttgctgtattttccatactctttgtctctgttcttcagcttagagtttttattctgtcctatattacagttcaaagaatgttccttctgctaaatctaattgtagttaacccatatgctaagtagttaatttcaattattgtattttta

SEQ ID NO: 49216 - DNA, 449 bp, Homo sapiens
tgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaattggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggactt

SEQ ID NO: 49217 - DNA, 708 bp, Homo sapiens
cagacaccacttagtaaactaatgaaagcctattgtgaaccacggggattgtcagtgaagcagatcagattccgatttggtgggcaaccaatcagtggaacagacaaacctgcacagttggaaatggaagatgaagatacaattgatgtgtttcaacagcctacgggaggtgtctactgaaaagggaacctgcttctttactccagaacgctgttctttaaagaccaagattactgcattctcaattagaaaactgcaatttggttccaccacattctgactactacagtatagttttctctattcttttgtttcccccttccacattcttttattatacatgaagtaactggtatgtgtacacaagcatattgcttttttcttcaaaccaaacagccaatggtgtgttttgattgacatcaagtggagacaggatgggaaaaaatactgattctgtgaaaataccccctttatcccattagtggcatgttccattcaggtcttatctttatattctagtaagttattttgctctcactgttttaacaacaacaaaaaaaaattctcacataccttgttcaattggaggattttcatgtttttcatttatcattgtaaaaccaaggacaattttataacttttgtgtacatagctgttacatgtagggcaatctgtctttaagtagggataaattactctaaaaaaaa

SEQ ID NO: 49218 - DNA, 354 bp, Homo sapiens
aacagggtctttgtcacccaggctggagtgcagtggtttgttcatagctcactggaacctcgaaatcctgggctcaagcaatcctgcagcctcggcctcccaaagtgctgggattacaggcatgtgacaccacacgcagcgcaattttctattttaaaataattttagacttacagaaaaattgcaaaaaataatagagttcctacttaaccttcactcagttttccttaatgttaacacctggcagtaccatagcataattattgaaaccaggaaattaacactgatgcagtactatggactaaccagcagaccttatcatgattttgctggctttcctggtaaggtcttttt

SEQ ID NO: 49219 - DNA, 403 bp, Homo sapiens
cgaaggcaaatctctgcatttttggtatggaattgaatttgggatgattagcagtcatatggagccatgttttatgtgtgaccaaagtataaaacttaatttttaaacattgtagtaaacatacacgtgtaatgtttcattaaattacataaccatagtaccagtatcaaaatcaagaagttacattgaaacatttaagtatgcagattctatttaatttaagcaatataataaatatacaataaataaaattggttatctggtatgattaaaaagtctcagtatggaccaaatatggtggttcatgccattcccagcagtttgggagggcaaggcaggaggctcgattcagtccaggagtttaggaccagcctgggcaacaaagtgaggccctgactctacc

SEQ ID NO: 49220 - DNA, 361 bp, Homo sapiens
aacttgccacttcatggtcacgggattgaattgggcagaacattttccaggccccagctggtagtgcctccttcacggaggcgggtatcttgtgccccactctggtgtatttgcactcccagaacctccttctttctctctcctcttcccccatcaggaatatatgctcatggttaaggaaacctagcttggatttccttggaatatatgtccatttaatttataattttaaggctggatgcagtgctcatgcctgtaatctcagcagtttgggaagtcaaggcagccggatcacctgaggtcaggagtttgagaggagcctggctcatgtggtgaaaccttgtctctactaaaaatacaa

SEQ ID NO: 49221 - DNA, 490 bp, Homo sapiens
tgctactttctggcaagcagccatcaaattatcccctttgtgtttttctgccttctagaaaactgaaaatgctgtctgatatggtcactttttcagtttccgtctgatacactctaggattagcagggaatttcatggaatgcagttgacagggagatcaataactgtagaagccagaagttctaggaagataggaaaaaacttaattttgcaggcagtaggaggggagacgtcctgaatactgggtatggtgcttgattctgtgcatatcatctcatttttccatccacaatagccagaagtaggtactattacctttacattttgatgaaatcgtggctcaacttaatgacttgccatgggtcctagtacctacttttttctatagtttatactatgtccataaacataaaggataagttaggcatagaggagtgagaaagccgagtaggaagtttgaacttgaaggagagggaatgacttgtgtatt

SEQ ID NO: 49222 - DNA, 445 bp, Homo sapiens
gcttcactgagtaatgtatatcttctaaatgttaatacattttgttatatactatcaaacaaattacattaataccaacactgatctcatcagaaaaatctttacatattaggaacttgtcaagcttatggtagcaggcacaagttttaaaacaatttaatggcggggagcggtgcctcaagcatgtaatcccagcactttgggaggccgaggccggcggatcacgaggtcagacaattgagatcatcctggccaacatggtgaaaccctgtctctactaaaaatacaaaaaattagctgggtatggtggcacgcgcatgtagtcccagctacttgggaggctgaggcaggggaatcgcttgaacccgggaggcagaggttgcagtgagctgagattgccccactgcactccagcctggtgacagagtgagactccgtgtcaaaa

SEQ ID NO: 49223 - DNA, 1896 bp, Homo sapiens
atttaaaatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgcctggaggtagtgcgcctgtgctgtgtacatccagagggcaacagtaatagccaacaaccagacaaactagtgaagttaatctgtgagtgatgattttatgatacttatatgcaaattaaaggcagaagttagtttcttctcaagatgcctttttggctgaacattaccatttttctttccccagggtttgaaagaaaagggccttttttggatttaactatattctgtctgcattctattcttcatgcgtaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 49224 - DNA, 2137 bp, Homo sapiens
ggggggctgggaaagttgaggccgcgctgccgccgggtctccggccttgagggctcgggctcgcagcggctgcggtggccgcaaaaagaggcggcgggggcggggggagaggagggcctgggcccgcgctcccccagccccggaggagcaggcggtggccgcggacggagagattcgcccagacggtcagacactcctgccttcccctcctgggatcatgacccaggcgggggtcgccgccgtcgccgccgccaccgcggccgagaccgcgcagccggcggtaagaagaaagcataacccatagaccatcttctggcagaagatgatacatttggatcagaaacgggaggcattggaagccaggaatcaaaagtgaagaaactctgcaagcccttaggttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 49225 - DNA, 450 bp, Homo sapiens
gtgcaggggagataaattgtgtggctcatcagaaacactgaccaatcgagaaattcatccagacatatctaccaacacttttgattgtaaagtgtcatcattcctataatgaaagggcatttgtcaggctcagctgggtccagggcctcaaaaatggcaagaagacctggtctttctccttccatctctgggctgtcccggccagctctgaggagtaagctggggctgaactgcactcagcgtcgtgtgagttacatgaccttcaccttctcctgttgtttccttcatcagctgtaaccagaacagccagtttgcattttctttttctttcaatcagcccatctaggatgagggctggacgaagccttaggaacttcgctgctgctgaaaagatctaagtgtcgcccaagtgggcagtctaggggcaaagccagggtggattttcccact

SEQ ID NO: 49226 - DNA, 424 bp, Homo sapiens
gcgataaagcctccctgagtaggcattgacttgatacccaataatggctgctaaggagccgttatgtagtgccgtgtcagtgatccgtgcgttgaggactccccgagtacgcattgacacgatagaccggaacggctcagaagaagctgttatggtctatcatgccagtgatgtgcggatattggagcggctctggcccttctgtggaaatgatggagtctctgaaggagctggggttgggccatgtgggcgccatcagttgagcctagcagcagctccattttccctttgccttgggtttacttcagaagagtcagctcggaaaagttgtccaattacttcagtggtcccaatattacaccaccaaaacgtgagcaaaagtgaaagatattcttgccattcgtctttcgtttcttctcaagag

SEQ ID NO: 49227 - DNA, 305 bp, Homo sapiens
gcctgctagaaatgcaggtcccagctcccccgccccccacccaaatcagaacctgtgtttcaacaagattccaaggtgatctgtgtgcacagtgacatttaagaagccctggttctcaggggaaaaaggccagctttggtggatggagccaatttctaggtcagacttacacgcatgctgcctagagaccaagaggcttcctcccccaccctgaaagcagcagtatgctcagctgatttaagttacaatattttgactgggtaatacttacatgattcaaagtttagaaggtgcaaaggatagtc

SEQ ID NO: 49228 - DNA, 480 bp, Homo sapiens
tgagaacgtgccactgcactccagcctgggaaagattgcgagactccctctcaaaaaaaaaaacaaaaaacaaacaaacaaaaaactcatctgtggaatatagatcatcatcgtaagggaatttttttttaaattgggcaaaaagcctggacaacatagcaagaccctatctctatcaaaaaattagctgggcagggccaggcgtggtggctcccacctgtaatcccagcactttgggaggctgaggcgggcagatcacttgagattaggagttcaagaccagcctggcaaacatggcaaaactccatctctaaaaacaagtaccaaaaaaaattagctgggtgtggtggcacacacctataatcccagctgctcctgaggctgaggcaggagaattgcttgaactcaggaggcagaggttgcagtgaaccgagattgcgccactgcattccaacctgggtgacagagcaagactccatc

SEQ ID NO: 49229 - DNA, 3585 bp, Homo sapiens
ggcatgtgagcggaagcttaggttgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcaga

SEQ ID NO: 49230 - DNA, 3993 bp, Homo sapiens
ggcatgtgagcggaagcttaggttgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatgccctccacagagcccacgctgaatgcccctaccttgacgaggtgaggccacccggatcctaagaaagaaggcagtagtaagagcactgtaataggagtcatgaagctcggggtctctctagaactggccacatggctggggttggggagtgggagccaggtctctcctttggggcctcattgtcctcatctgacaacaagattaaaccttatacctggttcttaccattca

SEQ ID NO: 49231 - DNA, 360 bp, Homo sapiens
  misc_feature (53)..(53): n is a, c, g, or t
tgatcccagccttccccccaagccaccaacctctgcctgtcacccctgactcncagctggccttacccattcagcccattccctgcaaaccagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatctctctcctgctcgcatctgtaagccctg

SEQ ID NO: 49232 - DNA, 2389 bp, Homo sapiens
  misc_feature (45)..(45): n is a, c, g, or t
  misc_feature (57)..(58): n is a, c, g, or t
  misc_feature (65)..(66): n is a, c, g, or t
ccagagattgtatagtcgtgcccgtgtatttcgtacggggcgtgngtactcttctannctggtgnncttcgctgccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcaga

SEQ ID NO: 49233 - DNA, 2321 bp, Homo sapiens
  misc_feature (15)..(15): n is a, c, g, or t
tcttgtccccggtanacatgggacggcgctcgggtgtgtggggactgaggaagccatgctgagctgcggaatgatgctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcaga

SEQ ID NO: 49234 - DNA, 3647 bp, Homo sapiens
ggcatgtgagcggaagcttaggttgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggcttctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatgccctccacagagcccacgctgaatgcccctaccttgacgaggtgaggccacccggatcctaagaaagaaggcagtagtaagagcactgtaataggagtcatgaagctcggggtctctctagaactggccacatggctggggttggggagtgggagccaggtctctcctttggggcctcattgtcctcatctgacaacaagattaaaccttatacctggttcttaccattca

SEQ ID NO: 49235 - DNA, 862 bp, Homo sapiens
ggcatgtgagcggaagcttaggttgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcagtctcatggtaggggcgaccccccacctga

SEQ ID NO: 49236 - DNA, 388 bp, Homo sapiens
gaaaagaaaatgagtgggataggggaagagagaaaaaggatagaggtgttgttttagagacactggttagaaaagccatctcactggaactgagatttgagctgacaactatataaattctacctgggagttttccaggcagaagagcaagtgccaaggtcctgagacaggaatgtacttggaatgtttgaggacccacaaggaggccagtgtggctgaagcacacaagccacggaaataatgtcagagaagccaggtgcctgattacacagggtcctttatgttgtagtgatgactttgttggtccttaaaaaagaaaaaggattgcaggaggcatgcttcagacagactgaggatggaacttctagctctggaactcaattttttt

SEQ ID NO: 49237 - DNA, 427 bp, Homo sapiens
cagccactgttatgacagtagtatatataggcttttatatttataagcaatctataaatatgactacttgtttaaacaaagctgtcatgattttttagtgtttttagatgtaaaaaattcaacagatatgaacttagaattggtctttttgaagtcctttaaaagggctatgcgtgagccaccgcgcccggccggtgcctagactgtttcatcaggacagcatttagttttttggggggtaagaacaggttttatcctgctgaccaaccttaagcacaagaattaatccctaactccatttagtgataaggaagttggatgaacaagtgatagctctggtaaaatgttatttctttttgccatcttggatgagtaatgtgtcagcagtaaggtaggaatcttggggcaaatgtactatacatatatt

SEQ ID NO: 49238 - DNA, 162 bp, Homo sapiens
cttgccatggcctcgcaaagtgctggggggattacaaacaagagccaccgtgcctaggaagagctcacttttgttgttgttgtcttttggttgttgtgtatgtgtttttttttttttttcaagacagcgtctcactctgttgcccaggctagagtgcagtgg

SEQ ID NO: 49239 - DNA, 387 bp, Homo sapiens
atagaagactgtcattctaatgtgtgattttcccatcaaggcataagccttgtgcaaaatcacttcaaggagttacctcttacgaatatgacctatgcttcttgcttaagtcactaaacagctgtggcgatcgtaagcagaagatggcatctccagttgttggtgctcttcaggaccacctgttgacagtgtgtatagtgagaacccctgaaggcatctgtaagccctccatgagggagtgttacatagtagtagcatctagttgatgtatgtcctggctaaataaatataagttggtttagatggaataaattctttgttttggggaaagtgtcattcttttaggacgcccaagcagaaagcttttatattgttggcagtgccgtg

SEQ ID NO: 49240 - DNA, 1603 bp, Homo sapiens
cgcatgcgtgtaaccccggctatttgggagactgagacaggagaatcacttgaactgggaggtggagcctgcagtgagccaagatcgcaccattgcactccagcctggttaacaaaagcaaaactctgtctcaaaaaaagaaaaaatgagaaggggtggaaaagagggattccagagtgccaggcacacaggttttctggaaggtttacatgaggactgctgtggtttgaatgtgttccccgaagttcatgtgttggaaactcaacccctaatgcaacagtgttgaccagtggaacctttaagaggtgattaggtcatgaaggctctgcctcatgaatggatgaagctagagtgggttagttatcttgggagggggttcctgataaaaggatgaggttggcttccttccctttctctctttccccctccccccttcacatgtggtcactctcttgcccttccaccttccaccataggacggcacagtgagaccttcaccagatgcaggcccctcactttcccagtgttcagaaccataaaccaagtgaacccttataaatcacccagtctgtggtattctgttatagcaacacaaacagactaagacagggacactcagtgggctcttctctctacttgatggagcactccctgcgtggtgccttgtatttgtagacatgatgctgtaaatgctctttgaatgtcttgaaggcttttatgtttgaggagtttacagagaagcccctacaggcttcaggtcccttcttctgttgcttctttgctccttagttcctcccctaacctggtgctaaattagatcatagtgtggtccttggaccaacagtatcaatagcacctgaaaatcatgctggaaatacagattcacaggctgctccccagaatactgaagaagaaactctaggagtgagacccaacaatctgtgtttaacaagtccccaggtgagtctgatgcacacagaaatgtgagctgctgtattagatggtgttgagttcatgccaccggatcactgacacacacgtctgctcactgcttgctctttgcacaggcccctggatcctcctggaatccctgatccctgttgctcccttgcggagttttctagtccctcttatttgaagcatgtctttcagagcctcgcaccacccagcttgggtatctggtgaattctgtggtctgcatgtccatgtttttgacattctgggaagggtggccaggctgtgatttgcatctactgctgcaggctatggatggtattcagaagggaggggagatgctgtgtgcgtgttctgaagggtttcccactaaatggagagactgactctctccataagtatttgatttttactttatctcctcgttgacttcacagtgtaagtgcagtttgtctctactgggtgatgcatgcagataaatgtttatgtgaacataagaagtctgcatgtgtgggtgaactctccacatcatgtcatttattgtccatcattacgtatctgtggtgtctagcacattcctctaccttattttctgtcattgtacctacttctacctgaacacgtattaaatatcttattaaaaatacac

SEQ ID NO: 49241 - DNA, 284 bp, Homo sapiens
ccaccgaaaagttcagaagtaacataacctgtttatgtgataaattttccaaacttatttaggcttggatatcgattaacatctgagagtgcagaacatattgagagaaatgctgatacagttaggatagtctagatctctgtcatataactacacagtatttttcatgagtcagacttttcttagtttgcattttatagtcaaataaagaaagggaatctttattttctaggcttttcacccaaccacatgacccagatgtagccaagctcgttaaaccagtt

SEQ ID NO: 49242 - DNA, 337 bp, Homo sapiens
ccaactctgccttgtatcatgaaagccactgtagatgatatgtaaattatgaacctatttgtgttccagtaaaactttatttacaaaaataggatgttggctggatttggcccatggactatagtttgcctactcctgctttgtagtgcttaaactcctttgataagaatatgaaagccagtgatgcactctagtgactgcctaagaactatcaagacaccttagtatgttatagttccctgttaaaacaacgggattatggtggattataagtgcagtttaataacatcaagaatcattatatttattttgtaggatgcactgctaatttatattg

SEQ ID NO: 49243 - DNA, 1074 bp, Homo sapiens
ttccacttaatcatcaaaaccattatattagggacatatgattgttatcattaccttagttttatagatgacatgacttaggtacataacaatgttcttataaaggtattaagtggaatagaaggcagtcagtactcagagtttagtgtgcaccactactcacttgctattcatttattcatttcattattacaatatgagaaggaatgaggttcagaaaagaaacataagttctgttattaggagattatcaaggttaagctttcctaagactttaacaggtgaggtgaaaaatatatttttcctgaggaaataagtttgttttaaatcataagcacatttacgtaggcttccattcacctgttttcctccttgccttcatataaagatactcatacaaatttattcgttttttgtgattatgaaaacccagtcaatgtagatcctttatgtgctttcttaatacaagccacatgcatttttctgctgagccatattagcattggcaaaacttgagcctgtcctttgaaatgaaccaaaaatgttgattctcatcacaatgaatgtaaaattttagaagtccaagagagagactggcctgagatttgtgtatgaagggataaatttgtataccacttgcacagatttcagtcttctgcctgagagtgcccctgtgtcctggccccagagctggtgttaccaaaacaggtccgggtcattgatattattactaaggtgttatctgagctcatggtctcatgaccaagaaaattaaggagtgtggacacaaaagggtgaggttggagcaaaagtttaataagtgaaagaagaaagctctctgcagtggagaggggagtcagagtggattgccacttttacagttgaatccacaagcttttatgagaaactgctctccaacacattcaaaagctagcagacagcaagaaacaactaagatcagagcagaattgaaggagatagagacacaaaacacccttcaagaaatccatgaatccaggagttggtttttttgaaaagatcaacaaaattgatagaccagtagcaagactaata

SEQ ID NO: 49244 - DNA, 973 bp, Homo sapiens
  misc_feature (1)..(1): n is a, c, g, or t
  misc_feature (44)..(44): n is a, c, g, or t
  misc_feature (148)..(148): n is a, c, g, or t
  misc_feature (181)..(181): n is a, c, g, or t
  misc_feature (258)..(258): n is a, c, g, or t
  misc_feature (262)..(262): n is a, c, g, or t
  misc_feature (297)..(297): n is a, c, g, or t
  misc_feature (319)..(319): n is a, c, g, or t
  misc_feature (325)..(325): n is a, c, g, or t
  misc_feature (351)..(351): n is a, c, g, or t
  misc_feature (365)..(365): n is a, c, g, or t
  misc_feature (384)..(384): n is a, c, g, or t
nggaggaaaactggccttccagcacccacccccacaccccctcntcccgtccccccagccgctccggagacagatgtccctgtggacaccaacctcattgaatttgataccaagtaagaaactcattcccctacttgaccctcttggnacaaagattcctataacattcaaatctgccctnatacctcttccttgcttttggtggggagaagcggattgtagcatcaaatcaagatgccttagccttgtgaggctgcntctngctgccttttctttgtcccttcctgtaaatacctntggtcccactgctgttcgaacncctctntcccagaggcctagcttcggggaggncagggattgggagnctgggacaagattcaaaanccctcacctcacaaccctctttcccaccaccaagctatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49245 - DNA, 390 bp, Homo sapiens
cacgcgtccgggttgaagaagcttccaggtgaggggaactggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49246 - DNA, 757 bp, Homo sapiens
attttctcttttggatttaaaaaaaaaaaaaaaaaaaaaaaaaaaaaaactcggagactagtttctcttctccaaaaagtcggagcccaaattgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgcccccattccttcaagaggagaccctttggggacaaggccgtttctttgtttctgagcataaagaagaaaataaatcttttactaagca

SEQ ID NO: 49247 - DNA, 402 bp, Homo sapiens
gctgggtgtctgcaacggggagctcccccggcgctgggggcaataaacggaatcggtttcacacgctttccctcttgatctaagatacctttaaatatccgccagagaatgatgttgcctggatgcgctgcatatggccatcaactgtgtgttcacgcgcggccgcagccatggagtggcggtgcgtcaagccgtgcgcaaccctgggtcctccggtatgcgcacatcgggagaaaagtggttagacacagcggcggcgtcaaaactcctactctcaacctcacaccaacacctcccattatcactctctctgcccccattccttcaagaggagaccctttggggacaaggccgtttctttgtttctgagcataaagaagaaaataaatcttttactaagca

SEQ ID NO: 49248 - DNA, 1928 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49249 - DNA, 1897 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49250 - DNA, 2194 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccagaatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49251 - DNA, 2242 bp, Homo sapiens
gacacacacaaacacacctcgctggttgggctgagtcctccctgaggacacacacagacacacatgcacatacatgttcacacacacacctgactggttggctgaggacacacacacacacacacacacacacacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaaagtggaccctgtagatggcgtggtgcttgtggaccctgactacctgaaggaccgcaaaggtactggccccaagtccagggggcccagggaaagtgggggctagggaagtgaaatgggctggccttggaagggcgccccagagagatggaggctggaggtggaagccaggagtagggttcaggcaagtcttatgctgctgagggaggagcagcggctgctaggtgccaggggactggggaagtggggctcctgaccactcatctcaccctcccttgccagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49252 - DNA, 1843 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49253 - DNA, 1600 bp, Homo sapiens
aactcaggctagtagaggccgggtgttaatcggccgggcgaggaggctgcgagcgagccgcgaaccgagcgggcggcgggcgcgcgcaccatgggggagaaacccgggaccagctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49254 - DNA, 1591 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcagtttatatcgatgccctttggcaagggctgggtttcccggaagcttctatattcccgggggggcttaccgctcg

SEQ ID NO: 49255 - DNA, 864 bp, Homo sapiens
cggacgcgtgggtcgacccacgcgtcggcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49256 - DNA, 926 bp, Homo sapiens
aaataaacaaagtatattacggctagtacgagactgagtgttgaattcggccgaggcaaggagctgtactaccatggggagcccctcaatgtaaatgtccacgtcaccaacaatccacattctgtaaggtgtacaccataaccccactgctcagtgacaaccgggagaagcggggtctcgccctggatgggaaagtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49257 - DNA, 593 bp, Homo sapiens
attagaaggattatggatgcggttgcttgcgtgaggaaatacttgatggcagcttctgtggaacgagggtttatttttttggttagaactggaataaaagctagcatgtttatttctaggcctactcaggtaaaaaatcagtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49258 - DNA, 1564 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccagaatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtagagctgccttttgttcttacagaccccagcctacagaccccatggcg

SEQ ID NO: 49259 - DNA, 841 bp, Homo sapiens
  misc_feature (521)..(521): n is a, c, g, or t
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttcccccgctcggacgagtgggncgtgaaggccgcaggatgccagtgacgagcaatgttgcagtgcgcttttgtccgcacagcaaataatgacgatgagggaaccctgaaaccaagaggcaagaaggcaacgaagcgtgagaacggagccgcgaggatggccaacaatgcccgagagcgtctgcgggtcacgagacatacaaacgaggcttttcaaaagagctcggccgcatggatgcaggctccacctcaagagtgacacgccccaaaccaagctcctgatcctccacaggcggagagcgcatcctcagtcatggaggcagccaggtccgagaaaggaaacc

SEQ ID NO: 49260 - DNA, 540 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttcccccgggagggggggggggggcgatgggggggtggcacg

SEQ ID NO: 49261 - DNA, 282 bp, Homo sapiens
  misc_feature (168)..(168): n is a, c, g, or t
  misc_feature (170)..(170): n is a, c, g, or t
gctgggattacaggcacgcaccaccacacacgactaattttgtatttttagtagtgatggggttttgccacgttggtcaggctggtctggaacccctgacctcaggtgatccgcccaccttagccttccaaagtgttgggattacaggcatgagccaccacacccagncngtctccagcctcttaggttgagatttggaggaagatctgggggctttctggaagaactgaagtcttctccttcctccgccacagataccccagaatcttccatgctccgtca

SEQ ID NO: 49262 - DNA, 746 bp, Homo sapiens
cacacgccacttcctcatgtctgaccggtccctgcacctcgaggcttccctggacaaggaggaggtggggcgtgagagggtgacacggatgccacggtgcagtttagaccctgggggaggggcgaagccacacatcaagaggacatttgtaaaggaggttgccttggctgggtgtggacagttgccgtgggcttgggtttgaggggagggggccagaacaatgtgtctgtgtttggggacacactgatgatgggaacagtgaaaaccagttccaattcacatgaccccctccccccaaaagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccagaatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagagtgagtatcgggagagaccca

SEQ ID NO: 49263 - DNA, 661 bp, Homo sapiens
  misc_feature (540)..(540): n is a, c, g, or t
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttcccccggcggtggcggaaggagcaggtgagggtcacaaanacctggcgctcctgcaggtagatcagggctccagaagtgcccacgccattctacatgcgccaatactccgagcaagtgtgccactgcgtccgtcacgcatggagccaggtcccagacggag

SEQ ID NO: 49264 - DNA, 419 bp, Homo sapiens
aactcaggctagtagaggccgggtgttaatcggccgggcgaggaggctgcgagcgagccgcgaaccgagcgggcggcgggcgcgcgcaccatgggggagaaacccgggaccagtggggtttccctttctgttttgttagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttcccccgggagggggggggggggcgatgggggggtggcacg

SEQ ID NO: 49265 - DNA, 3159 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatgaaaaaaaaaaaaaaaaaaaaaaaaaaaaaacaaaaaaaaaaaaaaaaaaaaaaacaagagagggggggcgcgcgccacaaaaaaatccccccgggggggcgcccccagaacgcgagcgcccacccgctttctgatgaaccagggggagccccaatagaagagagagaggcgaacatatataaacagcgaagcacgacgagggcccgaagattaacaaacaagggcagaggaaagagagaggaaaacaagcggcagaaacagggagagagaatcagatagagagaaaaacacgcccacaccacgagcgcgggggggggagaacccaaacaggcggagcaacaacacctccccccacaaaaaaaatatcaaaacaccaacagaggaggacacaaaagaacgaaaaatagaacaaagagagagactagacgaagaggagaggaaaaaccaacaccagcggacagacaaacaagagcgtcgaggacaccaccaaaacaacatgcgcagcaaacaaagagaaagaaaaagaacaataaaacacacacacaactcatactaagacccgaagggggacgagcagtagagcacaacaatacaaaaccagaacacccagaagaagccagaaaaacgagcaccgcaacaccaacaaccgaccaccacaccgacggcgagaccaaccagcacaaaaacgacagcccaaacagcagacacacagaccaaccaaacagaacaccaaccacgaacagccacacgaaccaaacacgcagcacgaacacagcaagaacaacagcagaaagagacccacccaccacaaaaaagaaagagaggaacagaggaagaaaaacaagagcgggcgaagaggagcaaaaaagaaacagacgagagagcgcaacgagaggacagacgacacagaagaagcgaagaaaacaaaaagcaggaagaaagggaaaagggaacgggaaggaaagaacgcaacaaagaaagacaaaaagagaaaaagaaacacgcagagaagacacagagagaataaaaaaagcaaaaaagacgaaacagaaagacgaagaaagacaaactaagaaccgagaaaagaagaagaaaggcacaagacaaggggcacacgacacgagaatacgaagaacaacaccaagcagaaaagacagaggcgaagccaacaaacacgagaaaaaatgaaaaagcacaaggagaaaagagaagcaaaagaagcagaaagagag

SEQ ID NO: 49266 - DNA, 1964 bp, Homo sapiens
  misc_feature (1340)..(1340): n is a, c, g, or t
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagcacccacccccacaccccctcntcccgtccccccagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49267 - DNA, 2022 bp, Homo sapiens
gacacacacaaacacacctcgctggttgggctgagtcctccctgaggacacacacagacacacatgcacatacatgttcacacacacacctgactggttggctgaggacacacacacacacacacacacacacacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49268 - DNA, 1689 bp, Homo sapiens
aactcaggctagtagaggccgggtgttaatcggccgggcgaggaggctgcgagcgagccgcgaaccgagcgggcggcgggcgcgcgcaccatgggggagaaacccgggaccagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49269 - DNA, 1404 bp, Homo sapiens
tagtggatccaaagaattcggcacgaggctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49270 - DNA, 1953 bp, Homo sapiens
aactcaggctagtagaggccgggtgttaatcggccgggcgaggaggctgcgagcgagccgcgaaccgagcgggcggcgggcgcgcgcaccatgggggagaaacccgggaccagataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggaggaggtggggcgtgagagggtgacacggatgccacggtgcagtttagaccctgggggaggggcgaagccacacatcaagaggacatttgtaaaggaggttgccttggctgggtgtggacagttgccgtgggcttgggtttgaggggagggggccagaacaatgtgtctgtgtttggggacacactgatgatgggaacagtgaaaaccagttccaattcacatgaccccctccccccaaaagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccagaatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatga

SEQ ID NO: 49271 - DNA, 950 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgcccccattccttcaagaggagaccctttggggacaaggccgtttctttgtttctgagcataaagaagaaaataaatcttttactaagca

SEQ ID NO: 49272 - DNA, 610 bp, Homo sapiens
agccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttcccccggcggtggcggaaggagcaggtgagggtaaaaaggggcggggggggcggaggccagcttggttgggaaaccgatctggctggggggaatggggggccaagaaaggacgggggaataggagcgacctttcggcacac

SEQ ID NO: 49273 - DNA, 1122 bp, Homo sapiens
aactcaggctagtagaggccgggtgttaatcggccgggcgaggaggctgcgagcgagccgcgaaccgagcgggcggcgggcgcgcgcaccatgggggagaaacccgggaccagataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagtgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtgagctgcctttgttctaatgcaccccagaggcccacagacaacattcccgactccccagagcccagcagacggtcgggaagacacacatgaccccatgggaaacagcgcaaaccctcgaagacaactgagacagacaccacataacgcccccaggaaggaagcgcccagtggaggttacgaagacaccatggccccggacaagccgcagacaaccggcgcacaacaggacagccgcaacaaagaaagaacccagaccacggccaccgcgaacgaggagacagagacaagcaacgcaccagcgagacggcacgcgacgacaagagacgggcaccacaagaaaccccaagcacaa

SEQ ID NO: 49274 - DNA, 535 bp, Homo sapiens
cagaggaagaacagtgagctggagagaagacagagaagctgtggagggtggagagagaatgcaagacaaggaggcccttgtagttctctcattctatggaaatgagacgcagtaaatactcactagatgagaactattattaatacatatttctaaaaaataattaagaaattccaaaacgttcagttcttcaagatgctatggagctagtatcattcattcattatcacttaggcattcattcaacaaatatttattaagcactgactctgtgtcagaccctatgctagccactggagtacaacgatgagcaaaaacagacatgaaccctgcctcatagagcttagagtctagtaagggagagagacattgaataggcaaatgtacaaatgaagtaactttaaggccaggtgtggtggctcatgtttggaatcccagcactttgggaggctgaggcaggtggatcacctgagatcaggagtttgagtttgagaccagcctggccaacatggcaaaaccccgtctctactaaaaa

SEQ ID NO: 49275 - DNA, 913 bp, Homo sapiens
ctggaaaatgtagatggtaaacagttaacacaggaaactatgtaaataaagtatgatatatctacacaacaaaacactatgcaactattaaaaagagagcttgatttacgtgctgaccaaaatgatattgtgatcaaaaaaacctttgagaatagtataaggagaccctgattctgctcaagccccatgccacgctgtgtgtgtcatacgtgacttgactgcacagcatgtgcaccaacttgttagtaacttgttaataatggtaatgaaggacttttatcttcttggttatgtattgttacaaggttaaatttttttttttagttagagcgtttttcaaaaaaaaagagagaagaaaaaataaacacccccaaaagaatacaggcacagatgcagataccaagtggtgaacaagtcccttacactatcaaactgaaacctcaattatttcaagtactctgtaaaggagcggagacccagcccctaattcaacattgaggctattagtgagcactcaagtcagtactagtgctgctggctgagaacagatattcaaagtgtagataataaagatgatttttttttctccagaaaattcaagaacctaactcataacctttgaccttttccatggagatgaaccagaaaaacaaaagctcaaaactccctcccaggaagcagtttaactcatatatatgaagagtcagaattaagacaattcaagatggccaaaactgaatttagtatctattccaccttacctctgtgaatggtaccactgctcattcagttcccctctctccccatcatccatcactcccccacgaatcaccgcactctatgagcacactccttactgtctctcacacccaactcttccctcaccatgcctactgccttaaatggggccctc

SEQ ID NO: 49276 - DNA, 417 bp, Homo sapiens
taaaactatgataaaaatttcccttctctataatggctacataagaaagaaagtatactcatttgtagcaggcatacttgcacagcatttcatccacctctttgtaaagaccagagggctttgtcttctctccagtaggtctttagaacaaaataacaacttgggctctcattagaactggttaatgtgctgtataggccatcctaagtgttggtatcacagcatacccaatgtccaagttgccatagtagggcatgctacagcttcatgagaaatgcttagtcagttgggtttttaagggctcttttacagcatctacaggcccctctacagaagtcccttgggttttattttagctgaggctcatttttccttctcactccaagactgacccattctttgacctcagataaaaca

SEQ ID NO: 49277 - DNA, 1996 bp, Homo sapiens
ctagaattcagcggccgctgaattctagaagccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49278 - DNA, 1631 bp, Homo sapiens
ctggcttctcggaactttttcagaagactgcgcctgtcctggttgcggcatggctgtcactgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49279 - DNA, 399 bp, Homo sapiens
atcgtcgacccacgcgtccgcggacgcgtgtttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttctta

SEQ ID NO: 49280 - DNA, 334 bp, Homo sapiens
aaattaataaagaaaaataaataagaaaaagcaaaaaaataaaataatacaaaaaatcaaatgaattaaaaataaagagaaacaaaagaatccaaaatgaagaagactctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49281 - DNA, 2261 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49282 - DNA, 2334 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttctta

SEQ ID NO: 49283 - DNA, 2153 bp, Homo sapiens
cctaggtacgggccgggggtaatcggccgaggcggggcaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49284 - DNA, 3036 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttcttaaagaaaaaaaaaacaaaaaaaaaaaaaaaaaaaaaaaaaaaaaaaaaaaggggggggcccaaaaaattccccccagagggggacccaagttttacacgggctgccccacgttcttcttgaacaaaggagcgcgccccccaattagacgagcacggtcgttaataatagcagcagacgcgcgcagcggcggcccgcataaacaacacccgtctgctgcaaactgaggaaacaacgctgcacaccacgggaaccatctggaagaagaaagagccccctcacactggcgggcggggcgcgccaccaacatctgcgcacaacacccaccccaccaggcagcattatagaccgcccccaggcggagcaagaccatcaaccacccctgcccacgctggcgttacatcgcgctggccacccccacccgcgcaaattcgtcgtcgcgcgccagaaaaaaaacttcccccccaccggcgactatttcactccagccgcaacaactttttaccgaggagctcttagttcaaaataaccagacgccagaccacgcagatacgacgacaccacgcacacatcaacaacatacataagtatacgactgaccgacacgcgagtacgcaagacagcagacgacggacagcgcgagcggcgctagtgccagacgcacagaatcgtcagcacaacaataacaccaccccacagccacaa

SEQ ID NO: 49285 - DNA, 2549 bp, Homo sapiens
  misc_feature (2311)..(2311): n is a, c, g, or t
  misc_feature (2317)..(2317): n is a, c, g, or t
  misc_feature (2327)..(2328): n is a, c, g, or t
  misc_feature (2330)..(2330): n is a, c, g, or t
  misc_feature (2333)..(2333): n is a, c, g, or t
  misc_feature (2336)..(2336): n is a, c, g, or t
  misc_feature (2342)..(2343): n is a, c, g, or t
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaaaagaaaaaaaaaacaaaaaaaaaaaactgttgggggggctggggccccgngaaaanttttttaaanncnttngtngggggnngggggcccagttgggatatggagacacaggggcaacaagcgtgtgccgaggggagaacccgggggcacggacaaaaggcgcggggatgtcccgcccgatagataaaaaacgccgcggggggaccaccgacggtttcgagaaatcccaagtggagcccgggggcccatcggggctcttcaaccgggttcaggggacgccgctccaat

SEQ ID NO: 49286 - DNA, 2608 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaactacacactatcacacgtaacaacttgccaagacacaaacacacacacacagaacacaaacacaacacattgtggggggcacccagggacccccgagaaaaacgctttcacagaaccaaattgcggtgtggggcgagcgggcccccaagaaggacaaaagcgcgaaccagtgggcaaagacgcgggcccaaagagacaaactcggcgcccaggcaaacggcggcggggctgctcccccaaataaaaaaacgcgcgggcggggaaccgcgcgggcctcggaccaactcccacaaggggctctagagggcacacggggatccatcaacaagggagccaaggagagcaataaacgcgagccggggggtaggggatgc

SEQ ID NO: 49287 - DNA, 2197 bp, Homo sapiens
aggagggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49288 - DNA, 2216 bp, Homo sapiens
gggaacacagaaaagaaagaacaaaaaacgcaggccgggaccgggccggaatgcccgggacaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49289 - DNA, 2472 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatatgaatgtactcgagggagtcaggagcccatgatgatggatgggggctctctatgcagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49290 - DNA, 2288 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctaagattaaataaaaaatattaaataaaacatggcaataagtgtcagactattaggaattgagaagggggatcaactaaataaacgaagagagtctttcttaaaacaccaccaacacacaag

SEQ ID NO: 49291 - DNA, 1882 bp, Homo sapiens
gtgggggtggactaagacacaccctagtgaagagacggtttgtggaatccatggcagagggattagagtgatggaatgaagaacctcaggggctagggggtttgtggagtggggacacccttgcggctggttgctcttacctctctctcctctcccagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatatgaatgtactcgagggagtcaggagcccatgatgatggatgggggctctctatgcagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49292 - DNA, 2058 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatcgcatttcagcagagggaccattttagaccaaaatgtactgttaatgggtttttttttaaaattaaaagattaaataaaaaatattaaataaaa

SEQ ID NO: 49293 - DNA, 2173 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49294 - DNA, 1245 bp, Homo sapiens
tgcactgcaagggtcgacgtactagtaggatcaccccagagtggtaccactgcccttactggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49295 - DNA, 1854 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49296 - DNA, 1349 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgcctttcgtttggtttactctgtactctcttcactgcacgacgtcactcagtacatataacacaagagatggacattagtgggatcgcgtttgaggtacaaggagctgcagcctaaatggtgaggagatgagccctcaaacagttcctcgactattttaagacagagcacaaagttagagactcaccatgctgtgcccagggcgtgtccatgctctattcctcttcatg

SEQ ID NO: 49297 - DNA, 761 bp, Homo sapiens
gggaacacagaaaagaaagaacaaaaaacgcaggccgggaccgggccggaatgcccgggacaggcctcggggcctcggagcaaccacccgagcagacggagtacacggagcagcggccccggccccgccaacgctgccgccggctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtaagcatgccagcctaccctcatgccttcccctgttgccagttgcagtttcttggacttcaagtttgttccttgctgtttaattagcccttgaccctgatgttctggctactcaggttcctgcccactgtgcaccccctcccctgaaggcaccattgtcttcctgaaggctcagcacccccaggccctttccatcaatggttatttgttctcaccctctacccgccgcccgcctggccactagtgaacacacaggcagctttgtcagctgtgggcagccctggaggctagagaaaagggggttgccaggaagctggggaaactgaggccagggtaaagttgccttagcttgcagccctttcccttcccagcaagctagataccttactcatatcccttcccca

SEQ ID NO: 49298 - DNA, 2087 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49299 - DNA, 2236 bp, Homo sapiens
  misc_feature (16)..(16): n is a, c, g, or t
  misc_feature (23)..(23): n is a, c, g, or t
tcaggctggtaccccncgagtantgggatatcgtcgaccacggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49300 - DNA, 2176 bp, Homo sapiens
gggaacacagaaaagaaagaacaaaaaacgcaggccgggaccgggccggaatgcccgggacaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49301 - DNA, 2354 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttcttaaaacaccaccaacacacaag

SEQ ID NO: 49302 - DNA, 2237 bp, Homo sapiens
aggagggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49303 - DNA, 2205 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacgtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49304 - DNA, 1613 bp, Homo sapiens
atgggaggaggctgcagcttggggaggagcaaagagccggcccctagccaatggccaccccatcctcaataacaaccatcgtaagaatgactgaaccattagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49305 - DNA, 2297 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccatttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttctta

SEQ ID NO: 49306 - DNA, 1299 bp, Homo sapiens
ctgaaactccagtttttatatgtgctacagcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49307 - DNA, 2035 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaa

SEQ ID NO: 49308 - DNA, 1674 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaacgcgcaagggagggagcctggatctccctgtgacccatgcttaacaattatccgcatccggaggggactcgaaaacgaagcgagcacaaccaacgcaaacaccaggaggccccaccgagggggcacactcctgcaggccgggcggaccacacaagtctacgaccccagaggacacgaaagctcacacagaccgggcgcctcacacaccca

SEQ ID NO: 49309 - DNA, 1169 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggtgagtaggcagctaggctacactcctgttctgaagaaatcaggagccttgcctttcttcccctcctgtatctccccggtgtctgacctgct

SEQ ID NO: 49310 - DNA, 494 bp, Homo sapiens
cccagtgtagtaaagatactctgccatgtctaatttgggagctggggaggggagggcaggcaagagaaactagacatgaccctgtatcctagtggtttgcaatctggttgggagaacaatgggtgcaaatgcgtgataaattatattttaaaaaaactcatctccatcccacctctgtgcactgattagagcccagctccagaaaattcctctctgagcagcaggaaggactaagggataaggaaggtggtgctacctggctggacccccaaaaatgctcttgggagaggcagagcacttgccagggtgggggacagccatgcagatggaaagggacaaaggcagaaatggagtcggggaggggttagattttctgccttatgggttatctgtttagtttgtatttagcacgttgtgagtgtacccatatcaataattttcctgttttctctacgaaaatctgcactttggctaacaaaatggtgcatatttct

SEQ ID NO: 49311 - DNA, 902 bp, Homo sapiens
ggtggaccccgctcccagaaaaggcaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49312 - DNA, 750 bp, Homo sapiens
cagaagtaaactggaaatcggagtgtcgccatcctagcatccagaggctgggcctttgttctcccaggcacagttccattttgactccactgtcaatgaattgatagcagagctcagtatccaaatgcatgttttaaaacaggtttttacatttgatttcccatttctcatatttaggtaaaacattgtcctataaattggggttgccacctgatagctctttttatgtggccaggtgcctccataaaattagatgcttgagatatcagatataccagctgtcctggagagagaaaagtttcctatcttttgcgcatttttccataaaggagtttttcttatctgaagagaagtaatggatcttgttttaatgactattttgtttttcccttcagtgtattccacaacagaaaaacgacagtgactgtggagtctttgtgctccaggtaaagaaacacttgcttttcggaacttacaatgtgtgaattgagtctgttgggttgagaggggagagatggcagttcctgtatgtgtatatgatgctaggtacgagcaacggagtactttccctcccctttattgctgaggagcagtagtttctgcatgttcagatgttatcattaggaagaaccaccttccagggatcaagagtgaagtgtgggtatcatccatgtctcactggaggttattagtaagccacattggagactgacttgaatttgtccatatcataaccattggcatttgcag

SEQ ID NO: 49313 - DNA, 518 bp, Homo sapiens
cagaagtaaactggaaatcggagtgtcgccatcctagcatccagaggctgggcctttgttctcccaggcacagttccattttgactccactgtcaatgaattgatagcagagctcagtatccaaatgcatgttttaaaacaggtttttacatttgatttcccatttctcatatttaggtaaaacattgtcctataaattggggttgccacctgatagctctttttatgtggccaggtgcctccataaaattagatgcttgagatatcagatataccagctgtcctggagtgcagtgacatgatctcggctcacggcaacttccactcccagggctcaagcaattctccagcctcagcctcctgagtagctaggatgatgggcacccacaaccaatgcttggctaatttttgtatttttgtagagacagggtttcaccatgttgccctggctggtctagaactcctgagctcaaagtgatgcacctgcctcggcctcccgatgtacaggtgtgagccac

SEQ ID NO: 49314 - DNA, 2346 bp, Homo sapiens
cagaagtaaactggaaatcggagtgtcgccatcctagcatccagaggctgggcctttgttctcccaggcacagttccattttgactccactgtcaatgaattgatagcagagctcagtatccaaatgcatgttttaaaacaggtttttacatttgatttcccatttctcatatttaggtaaaacattgtcctataaattggggttgccacctgatagctctttttatgtggccaggtgcctccataaaattagatgcttgagatatcagatataccagctgtcctggagagagaaaagtttcctatcttttgcgcatttttccataaaggagtttttcttatctgaagagaagtaatggatcttgttttaatgactattttgtttttcccttcagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49315 - DNA, 2741 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49316 - DNA, 3273 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaacagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49317 - DNA, 2690 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaacagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccaggtaaagaaacacttgcttttcggaacttacaatgtgtgaattgagtctgttgggttgagaggggagagatggcagttcctgtatgtgtatatgatgctaggtacgagcaacggagtactttccctcccctttattgctgaggagcagtagtttctgcatgttcagatgttatcattaggaagaaccaccttccagggatcaagagtgaagtgtgggtatcatccatgtctcactggaggttattagtaagccacattggagactgacttgaatttgtccatatcataaccattggcatttgcag

SEQ ID NO: 49318 - DNA, 430 bp, Homo sapiens
gtggatttgtttaaaaagagtcttctgttgattcctattcacctggaagtccactggtctctcattactgtgacactctctaatcgaattatttcattttatgattcccaaggcattcattttaagttttgtgtagaggtaagttaatatactgcctattttttcatttattttgtaattggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagct

SEQ ID NO: 49319 - DNA, 4286 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaacagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49320 - DNA, 4202 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaacagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgcc

SEQ ID NO: 49321 - DNA, 2442 bp, Homo sapiens
aagtgacgcgataagccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaacagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagaatataagaaagtatttgctgactgaagccagagaaaaaaatagacctgaatttcttcagggttggcagactgctgttacgaagtgtattccacaacagaaaaacgacagtgactgtggagtctttgtgctccagtactgcagtactcccttagacgcctttccgttttcgggatcctctagaacgccatc

SEQ ID NO: 49322 - DNA, 472 bp, Homo sapiens
tggaaatggagtctcgcactggtcgcccaggctggagtgcagtggcgtgatcttggctcactgcaaccttcgcctcccgggttcaagcgattctcctgtctcagcctcctgagtagctgggattacaagcgtgcgccaccacacctggctaatttttgtatttttattagagacaggctggtctcgaactcctgacctcatgatccgcccgcctcgacctcccaaagtactgggattacagcgtgagccaccacgcccagcctgctgaagtctcagtttctttaactatgaaatgagaagttaggtttgatccagtgaaattttattcagcacctactgcatgcatgctcctcttgattaggtaagtgttatgggcatagaaagatgaatgacatgttttgactcccgataactgcctaattggtgatcttctaagggtctgtaaatcttgtcttgttattttttaattaaa

SEQ ID NO: 49323 - DNA, 853 bp, Homo sapiens
atcttgtgaggaccgagcccccgaacaggcaaaaagtggcggtgcctggcacataggaggcactcccacagctgtggtcagctcaactacagggacccgcatctccctacagggttggcccccagcaaggctcaggacagcaaagcctacacgtccatcctgtacggcaatggcccgggctacgtgttcaactcaggcgtgcgaccagacgtgaatgagagcgagagcgagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggcctcccgggacatctggatgctgggcatagatttctcaacaaggaagactcccctgcctcctcaaggtctccattctcctaggagacaaagcaataataaaaggtgttagacaatgtaaaaaaaaaac

SEQ ID NO: 49324 - DNA, 2638 bp, Homo sapiens
  misc_feature (1195)..(1195): n is a, c, g, or t
ttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccaggtaatgaggctccccaagctgttccacacacagggcaccccctcagccaggctgacctgatctctactctccccctggccagctgaggaggagaacccggccttctggaaccgccaggcagctgaggccctggatgctgccaagaagctgcagcccatccagaaggtcgccaagaacctcatcctcttcctgggcgatgggttgggggtgcccacggtgacagccaccaggatcctaaaggggcagaagaatggcaaactggggcctgagacgcccctggccatggaccgcttcccatacctggctctgtccaagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgatccttggcggaggccgcaagtacatgtttcccatggggaccccagaccctgagtacccagctgatgccagccagaatggaatcaggctggacgggaagaacctggtgcaggaatggctggcaaagcaccagggtgcctggtatgtgtggaaccgcactgagctcatgcaggcgtccctggaccagtctgtgacccatctcatgggcctctttgagcccggagacacgaaatatgagatccaccgagaccccacactggacccctccctgatggagatgacagaggctgccctgcgcctgctgagcaggaacccccgcggcttctacctctttgtggagggcggccgcatcgaccatggtcatcatgagggtgtggcttaccaggcantcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcgggttggcccccagcaaggctcaggacagcaaagcctacacgtccatcctgtacggcaatggcccgggctacgtgttcaactcaggcgtgcgaccagacgtgaatgagagcgagagcgggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctccccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcagctggcgcagcggggcccttcttccctccgcatccccttcagggagcaggagcccagggcgccctgggagctgagcctgggacttccaggacctcccctcaggttgttctctgattcttcctcccaaccccagagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggcctcccgggacatctggatgctgggcatagatttctcaacaaggaagactcccctgcctcctcaaggtctccattctcctaggagacaaagcaataataaaaggtgttagacaatgtaaaaaaaaaac

SEQ ID NO: 49325 - DNA, 2556 bp, Homo sapiens
  misc_feature (1113)..(1113): n is a, c, g, or t
ttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccagctgaggaggagaacccggccttctggaaccgccaggcagctgaggccctggatgctgccaagaagctgcagcccatccagaaggtcgccaagaacctcatcctcttcctgggcgatgggttgggggtgcccacggtgacagccaccaggatcctaaaggggcagaagaatggcaaactggggcctgagacgcccctggccatggaccgcttcccatacctggctctgtccaagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgatccttggcggaggccgcaagtacatgtttcccatggggaccccagaccctgagtacccagctgatgccagccagaatggaatcaggctggacgggaagaacctggtgcaggaatggctggcaaagcaccagggtgcctggtatgtgtggaaccgcactgagctcatgcaggcgtccctggaccagtctgtgacccatctcatgggcctctttgagcccggagacacgaaatatgagatccaccgagaccccacactggacccctccctgatggagatgacagaggctgccctgcgcctgctgagcaggaacccccgcggcttctacctctttgtggagggcggccgcatcgaccatggtcatcatgagggtgtggcttaccaggcantcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcgggttggcccccagcaaggctcaggacagcaaagcctacacgtccatcctgtacggcaatggcccgggctacgtgttcaactcaggcgtgcgaccagacgtgaatgagagcgagagcgggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctccccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcagctggcgcagcggggcccttcttccctccgcatccccttcagggagcaggagcccagggcgccctgggagctgagcctgggacttccaggacctcccctcaggttgttctctgattcttcctcccaaccccagagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggcctcccgggacatctggatgctgggcatagatttctcaacaaggaagactcccctgcctcctcaaggtctccattctcctaggagacaaagcaataataaaaggtgttagacaatgtaaaaaaaaaac

SEQ ID NO: 49326 - DNA, 835 bp, Homo sapiens
ctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagccatctggctcac

SEQ ID NO: 49327 - DNA, 447 bp, Homo sapiens
ttctttttcttcttttttagacaaggcctcgctgtgtcacccaggctggagtgcagtggtgcgatcatggctcaccgcagccttgaccccagggctcaagcagttctcctagttcagtctcccaagtagctggcaccacagacatgcactaccacgcccaggtgattttccagtgccttaaacagtgcccagctgattttccagtgccttaatgatattaatcatcattacaaaagtgatttacagcctggccaacatgatgaaaccctgtctgtactgaaaaaaaaaaatacaaaaattagccgggctcggtggtgggcgcctgtaatcctagctacttcggaggctgaggcaggagaatcacttgaacctgggaagcagaggttgtagcgagctgagatcatgccattgcactccagcctaggtgacaagagtgaaactctgtct

SEQ ID NO: 49328 - DNA, 160 bp, Homo sapiens
tgtgtgcttgcaaaagctgcagattaataaatcatctgcaatggaattaaatttgtgaatatttatctctctaatattgtgtagcaggcatattagttaggaaaataatgaaccatacagatgcagtggcaaaaattgcagccaacccagatattttaaa

SEQ ID NO: 49329 - DNA, 301 bp, Homo sapiens
ttcagaattagaaggaatgtagaaaataatgagaagtacaaagaaggagatgaaaatcacagtctgatttctcatgaatgccattaacatttgctatttttgattgtcttgtttaatgtgcataaacatatttgcaaaattaggattgaagcatgtatacaaatttgtctcctgcattttaaaaattgagcattgtactatgaatattttcctaaatcataaaacagcctatcaaagcacgttttcttagctgcttaatatgatgcatgatatgtgtatctaacataaatatccagtaata

SEQ ID NO: 49330 - DNA, 727 bp, Homo sapiens
tcttagcccttccctttctgggggatggtgtaaagaggcacatcgcgtaaaatggtcacagagcagattgccatgcagcctagaaccaggagtctggtcttgttgctgtgttccctggtaagagatcatggcattatttcttaaatggctaagtgaaggtgggagagttggggaggggaggagggaggtcctctgttctgccaattaatagtctacctctgtgtcctgattcctcttctcaagcaggaatgaaaagcctccatattaaaacgaaagggtttggaatcagggtcttagttcaaatcctgtccttaccacttcactagcgtactcttggacaaaattgctaattctctcagtttgcagatgtgtaaaataggactgacgatatttgtagtgtgattgtgaagaataaggcaaattagcacaaggaaaactaaaaactcaatatgtttgtgttagcctgtttgtgttgctataaaagaataaagaatatctgagattgggtaatttataaggaaaaaaaaaaaaaactcgtgccgaattcggcacgaggcgacggtagctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacagggactcggtggagtgcgctactcaat

SEQ ID NO: 49331 - DNA, 419 bp, Homo sapiens
taaaacgtttttatacagcatggctgaaaattgaacctggcctccctcgtggcctaccactgaaggaacagcattttttgcctatctagaaagacaatgttaaatgtgctatctatatattttttaacttgtgctacctactacgcgtttatatttgtggaatctgttttcttttggacaaaaccacaaatcaaaaacacctcatttcttaggcatttgaaatccctaattcagaaatatctcccaaacagaaacacaactacctgcattctttttgacaaaagagctaagtagcattagaaaattattttaaacccaattctgttttttaacagaataaaattcttctgttcttcacattcttctttcataggtaacctattgaaagtagggtttatttgggggaagcatttctttct

SEQ ID NO: 49332 - DNA, 839 bp, Homo sapiens
gtggaatcaatttaaatacttaacagttttccctgaagtttttttcagctgtttcttcctgacaaaagacacacactctttcaaaaaaaaaatgacactttctgaaaatatgtttcctaatatttgctacttatagcaaatacctttttttaactggaatattcttttctgttgtttgttcagtaatttaatgagctgctacttagctgtatgtccctcagtacatctcttttcattctgagcctaagtttcatcatttatgagatgttgctaatacggataactgcactatataaactaagatcaaataaatatgaaagcctttaaatatatatgtactgcatatgtaatataaatggaatgaccttatcttaattgttcactccacttgaaataattcttaaaatgtagtagtcagtgaatatttgttaaatgaatgaatgatttaaattgtgtaatttaaattacaaattgcataataccgtatgtgaatttgcaaagatttgtggatagaagattgtcatttctactcccattatgactgacacatggtatttcttatgtatatggcattatgccaaaatatgataattattggagctttaaatccatgagagctgtgctcagtgggctctggaataaagctggagttcaaaagaagcatttaaaaatgaagtagagggcatagtggcacatgcctttagtcccagctacttgggaggttgaggtgggaggactgcttaagcccaggaattcgaggctgcagtgaactatgatcatgccactgcactccagcctggtggcagagtgaaacttcatctcttaaaaatataaaataa

SEQ ID NO: 49333 - DNA, 342 bp, Homo sapiens
agcaatagaaactatccaaaatgaagcacaaagaaaagataaattttcaaaaaatgaataagtcatcagggaactgtgggacagtttcaagtggcctatatataaaggactagtaagcgaagtccccgaaggaaggaggaggacagaaaaaatacttgaagaaataatggctgaaatttttccaaatttgatgaaaactatataaacccttagatccaagaagttcaatgaaccctaggcacaaaaaaaatcatgaagaaaactacactaaggcatatcacattcaaattgctcaaagccagtgataaacattgctagaggagaaagacacattatatacag

SEQ ID NO: 49334 - DNA, 417 bp, Homo sapiens
taaggatgttgatatacattgtattaaacaagtatacctcaatttaattaataattccagttttgacagacaactggattgtttccagtgtttgttacaaataacactattttgaacattctcacatatttattgatatgcatatgcaaaactcccctctggcatatatccaggtgtttcattcctggggtaatatggtgtgtccatgtaggcaaataactaggataatatcaaattattttcccaagttgacagttttcattctcactgggtatgttggagggatcacttattgttctgtattaattaacttaatgttgcctgactacaaaattatgtaggcctgatacatattaaaatgtgtctcacgaggttaaatttacattcccctgatatctaagaatactgaatagctct

SEQ ID NO: 49335 - DNA, 1029 bp, Homo sapiens
tgaggctgggtaatgagaaccaaattgcaaatttgcagaatttttttcctaacattgtcaaacaattggtaatagtgttttgagattgaacagaatttgatgtgtttaatttgtaaagtgtatttttttgtggttacacagaagcagtaaaaaccttgacagaaataatgagctttaacataaccacagcctctaatctaagaattctgtgtaaggaccagtcttaccagagataaggtcaaatattttcctgtaagattttctcagcatggagagttgagagaactgtttaatcaagagcaggatggatggaagtatgtacaacaatgcttgaagtaagagggaaaaaagaaagcaaatgggtctgaacatatccatcagtattatttgtatatcacctattagcttctaagtagtatcaatattaataaaagaagtcttaagctctctgtgactcatggtcatgtgaaaattagaataccttagtttcctaggattcagtcaaccttgggattatgggtagtcagcctgttacgagagtcctggtctttaaagatctacttttagcaacaattcaggtatttagcaatatctgaaaactgtcaagccctgctcttttagtgtatatttactgttaaagcacagaacttcctcttttatattagtagaatttgggaggatgctgattcctattgaggttttgttcgattgtttgaaagtctaatgcagtgaaaagattactcatttctgtgcttcatcaacagttatttggcaccctttccctgtctttcgtgggttaagcatatcactttgaagtctgttcagttatgtactttaaacagaagtaacatttgttttccaaattctctttagccttcaaacccttttttctgaaatagtacaaaaatgaatgtttgcatagcaccttacatttttataaaaatataaatctcatatgattaatcttcctcatctttccccagatcatccctagcggcccaccagcataagcatatcctcatattgaag

SEQ ID NO: 49336 - DNA, 161 bp, Homo sapiens
attttaatctaacaattcaccttctttaataagaccatttaggttatctatttcttcttaattttaactttcaaggaatttgtccatttcatctaagttattgaatttattgattttccataaaatttaggatctgtgtgatgttcctccttgcattacta

SEQ ID NO: 49337 - DNA, 498 bp, Homo sapiens
ccctggggcagctgttgacactagaataaataaaacccattgtaaataaatgatgaatgacatctttacgcccaccatctgctggtgtaaaggttgttggaaggccaaggatgcagattttatcagttatatcataaactgcagtgagctttcaacagtcatcaaatggaattctttgagcaatcattttattatgaaaagcaaaatggttctgaatttaatttatataagtttttttctccacacttaatcaattttctctgtatttgatatataatgcttgtcaaaaggcaacaggatgtaaaagtcatctttatatccacttgtgaaacagacacaagagattatgcaaagctaggtaatttctcttttactcatggtactaatttctgtttttttaagaattgctggggaggaatgtgactgttctgtctgagtttaaaaccgagacagctcttataagaagttatttttcatttttaatcccttcttttccta

SEQ ID NO: 49338 - DNA, 761 bp, Homo sapiens
ggaatacatatatgttttttttcgtgacacttttttttttttgcttttggagatttttcaatttggctccaggacctgtatgatgttttcaagctttgcagagatgctcaagatatgactggacatttttgaaagttcctgtgtcctcttcaacacatcttctcaccaaacattaattgtagtgtcttttcttccagaaaacttgcataaaatgacttcctctcctgtgaaaacagtgtcctgctctgaatggagctttaaaggagtaggcacaaattgtaagatgatgtatcttgagggctgggggcttaggaggatattctgctgcctcccagaggctttgtggcagacggggtctgccaggggtggggaaagggaagcctccgttctttttggtaagctagccataaagacaggtaagggagtcctattttccaagaaagctgggatctgtttccgtactctttcctgccccctaatcgctgtggacagctcccagcagcacaaagagatgaagggcaaaggcaggatgcagcaggcaaagttaacattgtatttgtgagtacagttgaggataaaaaagggatgaaatccacggtgaggaccatcatggtgggggaatagtttattctaatggattcaagagctttggagaccaaactaacacatttatttttatgtgcagttaaagtcatagaaacctgttttgtgaaacctcagatttctaaagaaaaccagaagcaagaccttccttggtttaa

SEQ ID NO: 49339 - DNA, 1042 bp, Homo sapiens
gacaatgttctttggtaggcctaggtgagttaagttaaaagaggcacaagatgtgacaataaaggactctttttatagtagaagacataaagagaattccattgtaagggtagagaaaatttgttgtaagtttgattctttttagaaaactgatcatgagaaagattggtttttcttatgggtatagaaataactttattacataaagcacgtctttgaagttgtactggataaaatgagctcctcacatcagtgaggtaacaatagcaggagagagactttccaaatcctaagagttaccaaaacttctagaccatgattttgtacctttcatgcccaattttgaaaatgtcagtaaatgtgttcttaacatttagccatcacacaaaagagggttcatgtaatcttggtctccttgcattgtgaaatttcaccagtggtagtttgcagttgcttttgagaacatccagtttcacctaatctgtgatttgactgtatagatatgattactggatttcctatttaattatatttgtgggaggaggttactttttcattttgtattgttttaatgaaagtcaagccataacctgcttatctatttcatttagagtttctttcatttggcccctactgagctttatacaaaccctttttgttatttttcctactttgaagctctgtttttcagacttcagtctatgtcagaatcacctagagagcttgttaaaataccaatgactgagtcctgtccccagagtttcagtaggtttggggtgggacctgagcatttgcatttctaacagtttcccattactgggattacaggtgcccaccaccacgcccagctaatttttttgtgttttttagtagagatagggtttcgccatgttggccaggctggtcttaaactcctcacctcgtgatccgcctgcctcggccgcccatagtgctgggattacaggtgtgagccaccatgcctggctgaagattttttttaaagagtctgtttcagattattcacctcatttgagttccagaa

SEQ ID NO: 49340 - DNA, 374 bp, Homo sapiens
tgttgaattacgctcctgaatttaagaatctagacagtttgaaaagcttatctgtgacctgttacacgtaagctctttttctttttctcttctcttttaatttctgtttcattgaattaataacagagtcttgctgttgaatgtggagttggcttggtcaccactgccacagggatctcttttttgttttgttttgttttgttttttgagacaaggtcttgctctcttacccaggttggggtgcagtggcgtgatcatagctcactgccaccttgaattccaaggctcaagggatcctcttgccttggccttgtgagtagcttgggaccacagctgcacaccaccatggccagctaaagggatcttttaaagac

SEQ ID NO: 49341 - DNA, 321 bp, Homo sapiens
tatgggcagttaaaaaaacaaaaaaaacaacgaaggagtggtttgatatcattaggtttacattgagcttgtatcatccatagaagagtcagggttagaccctctggggaagagagtggacaacaaagataagccacactctactctatatccatgaaaaaatagtaaccatctctactaaaaatacaaaaattagtcatgtgtggtggcacgtgcctgtagtcccagctactccaggaggctgaggcaggagaattgcttgaacccgggagttggaggttgcagtgacctgagattgcaccactgcactccagcctgggc

SEQ ID NO: 49342 - DNA, 1575 bp, Homo sapiens
ttatttatttttctttgagacagtgtcttgctctgtcgcccaggctggagtgcagtggctcgatctcagctcactgcaacctccgcctccaaggctcaagcgatcgttccgcctcagcctccagagtagctgggaccacagggaccacaggcgcccgccacgacgctggcattgattgattgattgattgattgagagagaggtagcctccctgtgttgcccaggctggtcttgaactgctgggctcaagcaatcctcctgccttggactcccaaaatactgggattacaggcgtgagccaccgtgcctggctaattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacgtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagaactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaa

SEQ ID NO: 49343 - DNA, 1630 bp, Homo sapiens
ttatttatttttctttgagacagtgtcttgctctgtcgcccaggctggagtgcagtggctcgatctcagctcactgcaacctccgcctccaaggctcaagcgatcgttccgcctcagcctccagagtagctgggaccacagggaccacaggcgcccgccacgacgctggcattgattgattgattgattgattgagagagaggtagcctccctgtgttgcccaggctggtcttgaactgctgggctcaagcaatcctcctgccttggactcccaaaatactgggattacaggcgtgagccaccgtgcctggctaattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggctcagcgatatgaggcagcatcgacaatttatggaccgcacgcattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagaactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaa

SEQ ID NO: 49344 - DNA, 1483 bp, Homo sapiens
ttatttatttttctttgagacagtgtcttgctctgtcgcccaggctggagtgcagtggctcgatctcagctcactgcaacctccgcctccaaggctcaagcgatcgttccgcctcagcctccagagtagctgggaccacagggaccacaggcgcccgccacgacgctggcattgattgattgattgattgattgagagagaggtagcctccctgtgttgcccaggctggtcttgaactgctgggctcaagcaatcctcctgccttggactcccaaaatactgggattacaggcgtgagccaccgtgcctggctaattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggctcagcgatatgaggcagcatcgacaatttatggaccgcacgcattatctgcttacattcagctcttcagaaaccttgctaaggctattgctacgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagaactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaa

SEQ ID NO: 49345 - DNA, 429 bp, Homo sapiens
aacagaagtttgttatgtaaacaaatgctatcaaccatttgttcacctagcaaacttttgttaagacctgcaaaggaacaagcaccataaaagcaccagggttaagatacttgcacatattatttcaatatactcttcatcattttagtacatttatataacatactgcaattgctaacgcatatgcacatgctttacttctaaatcacattttagataatttctttctgtgcaagttcttgtagacctaatccaaagtatacttactcactctttggcttcaaataatataacttgtctgctttttaaccatttttctttccgaatatcccactgaaagctgatctaacattgggcctatggaccttggccctgcctgaattctcttgagggccaagggccctccagcatcacagactgtctgagaca

SEQ ID NO: 49346 - DNA, 905 bp, Homo sapiens
ggtgggagtccagaaggaagatactgcaaatacttttttcaacatcactttctcataactaacaagatcttttctccagaatagctctatttttttaaaaaaattaattgtgctaggagctctcataagtatttgcatatccagaagttgacctagggaataaaaagaggcagaaaaatagtttagtggcttactaattaacacaaatttgagttatatgcaaactcagtagtgtcttctcagcattaactatagacagttcatttgtcctgaaagctttattgtttgattgtgattgtgtagatctttctcccataaaacattggattagtaggtgtacatatatgctaaacaactaaaatacagcttaatatccttaatttagatacattttaaatcttaactttagcaattatcttttcctttggcttctctgggcaactagatttcaactcatgacttgattaagccatctccattttgaactttctgaaaaaacggaagaaaatctctgatttttcatagtaaaacataaatttaattactggtaggtatatattctacttgctttttttgaaagctttagggagaatttcaacctctgcattaaaagtcagtaagaaaaagctcttacgacaataactttcccctaaaaagcacaaatgcttctttgcctgtcatttaaaaaatatttattgtgcactcaatgcagaaattgtaatgatatgatgctctagtagagttataaaatctttgacgtaattattagtttggagaaagtaaaggcctaggtatcaatatctaaaaatatataaacatttttttgatcttaaacagtcattctcaacctcttccattttttctattcatacctcttataattcaaacagcaaaatataaatcct

SEQ ID NO: 49347 - DNA, 348 bp, Homo sapiens
aaaaatattgaagacgacagagaaaatgatgcattacttaggagagcaacaatttcaatgactgtagatttctcatcagaaaccatggtagccagaaagaagtaaaaaaagcatttttaaagggcctaaagaaaaacacagtcaaactccatcgagtgaaaaattcctgcagaaatgacagtgaaataaagctgtctcagataaagaagaactaagagaatttgttgccagcagacttcctctaaaataactgttaaagaattttgttttcagaacaaagcttttcttttaaaaagaaaactatcgttaacatttagctatattagtatcagacaaagtagacttcag

SEQ ID NO: 49348 - DNA, 332 bp, Homo sapiens
tcatccacttcatttaaatatacattaagaatctataagagccaaatatcagtcattttaaaaatatgataagcacttaccacaggaaaagcacagatatagcacagaaaagttctagaatacatcactaagtaccactttttaatacttattagcagctttctggctttttttttttttaagtactaaatgttcagtttaaaacaactgggaaatacaaagagcctacaaagaaaattttaaagtacctgtatccctagtattcagaagtaagctctactattaaataagatattctttctttttatatgtatcgttaaataaataacata

SEQ ID NO: 49349 - DNA, 398 bp, Homo sapiens
tggaagaagctttctgcagaaataatccagcagacacaagacaacggaggtactcggtggaaagggaagtatggtttgagcccctggatccagctatagttgaagccacagctatgatgagcttaaatgagcccaagaagttttttttaattgcttcatccacttggaatttgcagtctgtccctggcaaaagagccagtactaatgcatatctgctctgtgaactcttccttagctgccttgctcaaaagctaatcattccttctcttatactttgaactttagtaccctccactgatttccatcattgcctggtttatgccatgttgtaattgcttgtttcagccctctcaactttgacttgtaggagcaaggacctaagaggtttcctggggctc

SEQ ID NO: 49350 - DNA, 258 bp, Homo sapiens
caaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccagg

SEQ ID NO: 49351 - DNA, 237 bp, Homo sapiens
gggaaatcgcaaggaggagctggtagagaaggaagaaaaatcttcacctggggtttcactgcattgtgtttgaggtgcgggaggtataggagagacatccaaacacgtggagtcaggaggtgagatttagatctggaattcactgaagggggagaccccgatgtacgtgttgggagtcatctacctagaaaagaccggcaaataaataagatggttaaaaaagagagagtgagatca

SEQ ID NO: 49352 - DNA, 103 bp, Homo sapiens
tgggagggattcactgtggactgaatttgtagattatggcaagttattactatattagtgattaaatggcactttttcaaatcccttttaatttgcatggagc

SEQ ID NO: 49353 - DNA, 1494 bp, Homo sapiens
ggggtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtc

SEQ ID NO: 49354 - DNA, 445 bp, Homo sapiens
  misc_feature (38)..(38): n is a, c, g, or t
agaatttaaataccgacctcacctatagggaaattttnggcccctcgaggcccaagaattaaattaaacccccaggaggcagaggttgcagtgagcccgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagca

SEQ ID NO: 49355 - DNA, 1031 bp, Homo sapiens
gctaagcagagtaagtaaatcgaaataaaactttaaaaatgcctttatggagagaatgactatctctgaaagcttgtttttaatgatgataaaattcatgatcagaatttgtttctgtttgctttaattcaggggtcaaaaactgaaataccatcagaggcccaggaggggctagttgtaactggcaaatatagtaaattaatttgctctggttgataggtagcaagcagggtttatatacattgtcacctacttttccagttaacaggagagactggagattttatgaaatttgatatttaaatgttggtaactgggttgggcaccatggctcacacctctaatcccagcacttcgggaggctgaggcgggtggagcacctgaggtcaggagttaaagaccatcctgaccagcctggtgaaacacagtctctaataaagatacaaaaattaggccgggtgtggtggctcatgccggtaatcccagcactttggggaggccaaggtgggcggatcacctgagtcaggagtttgagaccagcctgcctaaatggtgaaaacctgtttctactaaaaatacaaaaaagtagctgggcgtggtggtgggcgcctgtaatcccagctactctgggggctgaggcaggagaatcacttaaacccaggaggcagaggttgcagtgagcccgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagca

SEQ ID NO: 49356 - DNA, 220 bp, Homo sapiens
catcaccccatgccatgtcccctgtacccctcatgctctgtggactgaggaagcgcagtttctggacctccagttcgcctcatagacctgtccttcgaggaacaaactctgtctgtctgcctcccctctcccacactgtcttctcaagacccttgccctctcatctctctgcctttttttagttatgctaaaatatgtgtgacataaaatgtaccatcct

SEQ ID NO: 49357 - DNA, 495 bp, Homo sapiens
aacaaggagtcagtactcagtccttgggtgtggttgaggcttgaggtcctgattgagcaaggcagtactggacaaggtctacatcagcattcaagttcaatggggggcactagtggcttcaaacttcctggtctaattatgtctttagacacttaataactactgagggccttgaggagctcttgtttatttgggttgatatttgttaatatttatggcatttgacattaaaacagaaaatgttaaaatgttatttactaattcatgttaaaatataatgaatgaaccaaatgtaggttaatataaatagaatgctttctgaaaaatcaactgttgtgtccaaacaaaaaaacaagaagtgtgacactggttaacttgtttcaaatctgatgtctggcttaatggaagatgtttgtattctcatatctgcttttgtattaaatctgttggtatatcataccctaccaagagaatgagatcaaaaacaacaaatgt

SEQ ID NO: 49358 - DNA, 351 bp, Homo sapiens
cggtgctggtgtcctcatgagagcaggagagcagacactgacactcgggtgaaggctgcatggagtcagagcagggcttggtgtgatggcggccacaagccaaggaaccccaggtatttcctgcaactccagaagctggaagaggccaggaaggatcctcccctggcgccttcagagagagtctgtccctgaagatgtcttgacatttgacttctgggttgcaggtcttggcggcggggtacatttctgatgttagaagccacctggttggcggcgatgtgtcactgcagccccccacaggttctgggtgtccatgtggtcgggggcagaggtgggcagggacagacatgt

SEQ ID NO: 49359 - DNA, 424 bp, Homo sapiens
actgaagtggagttacatcctatgcaaatgaagattgattggcggccaatcagaggctgaagtgaaggcttggcccatggccatcaaaggctgaagttctccctttggtttaattccaagaagtcagccgtgggttggccttaggctccttgtctccagaccctattctcctgcctcagttccttctttagaatatattactaataactgcctgggaatgatattgccctagacatagacacttgagtgacttcctgcaatgtagccttctaagagagtccatccctacagcatgtccacaggcagtgtgaggcttcaggggtcccctggcagctggcagcactgaagaatgagttcaagcttgaaaattgactgctaatcacagcaacaataaaactattattttttaaaaatctgataacat

SEQ ID NO: 49360 - DNA, 525 bp, Homo sapiens
tgagaagttcagtatgtttgaaagcataattaggaaactttttaacatgtactttctccctgcactctaaaccccaaggtttagagaaagttaggaaatatttaacttcccacacgcttttatttacagagcagtccccccttgtctgtgatttcacttttcacggtttcagttatctgcattcaaccatggtccaaaaatattaaatgggaaactcggccaggcatggtggcccacacctgtaatccccacacattgggaggcctaggtgggtgaatcattgagcccaggagttcaagaccagcctgggcaacataccgagaaccttgtttctacaaaaaatacaaaaattagccgagggtggtgggacgcacctgctgtcccagtaactcaggagactgagctgtgaggatggattgagactaggaggtcaaggctgtggtgagatgtgattgcaccactgtactccagcctgggtgatagagtgagaccctggccactgacccccaccccacaaaaaaaaaa

SEQ ID NO: 49361 - DNA, 372 bp, Homo sapiens
gagagagctagcaccatgagcttcaatacctggagttgtattgttcatgtaacatacaatgagaatggtgcttcctggagctgtgcagtcaggcagcctgctatcttggaagactagagatgatggtgagttcactgttcactcctctcctccagtgaccttgtcctccacctttggagatacactcccatgcatgctcgtgagagcatgtgcttccactgtgggggaggaccagactttgtttgtatctaatctgttgcagaccaatacttttgtaaaatatagtcacaaaaatgagattaaaaacacaaaggcattccaaatacaagtccactgatcatatgcttggatgtcgcagcagtgtttctaaac

SEQ ID NO: 49362 - DNA, 369 bp, Homo sapiens
cctgggattacaggtgtgagccagcgcacccggcctcttgccctctttagagcagttctacataaatctgtggaataatctgctgacgttagaaataaacctttctcagggtgtggccataatctggttcgttgtaattgctgaaggaaaaaactgaacccttaggaacagtttaaacattctaggtggtttttagatatattattcctgttagagttttgaactttgatcatcttgttagaaaaaagaggccaggcactgtgcctcatacctgtaatcccagcattttggaggctgagtcgtcaggaagtcacttgagcccaggagtttggtaccagcctgggcaacatatggagacctcgtctctac

SEQ ID NO: 49363 - DNA, 508 bp, Homo sapiens
taaatatttggtttaagaatatttaaaagggctgtgttctcattgtggaagttgtagatacctaaatgccacttcataatgggcagataggaatgctttcttaaaatattttttctagagggataaaatctaagcaggtttcagaactttagaactcctgaataattttggcatgtgcttaaactgcccttttgacctgcttttaacatacaagaacagtttaactcaaatccagtgcaccttcctgccagagaaagtgctttccttttggatgacttgacttccaaagattgaatataatgttaaaatggtttataaaaataaactagccatgttttccgatcaaaaaattgacctaaatctcccctgcttacttaaaaagattccttctctctcttagtttgtggaataatgaactcatcccaatttttaattgctgaactgacaaaagacaatccttaggtgtttgctagtttgttctccactctttttgtttagagaacactga

SEQ ID NO: 49364 - DNA, 1204 bp, Homo sapiens
cagcacattctaccaccattggcacctgaatactcctctagggggcctgaggttggttctacccacccctgccactacaatcacagctgacacctacctgcacatggcacctgcaggcttggagactgagctgcccaccccctcacagccaccaccaacaccagcatacactgctcaagacccagaagattatcccatcactgccactgctgttttatgccagctgcccagaggcccaagaatctgcccacccacccagctcactgctgccactaccagcatctgagtaagccacctgaaggccaagaattggcccacctggactactagtgccaactcaccactgcctctactggggctcaaagactggcctacctggtgccccagtcctcagcaaaactttaccacaggccccactaataactgcacctgaaaccactgaataaattacaaacaccactgacactgttcatagccaaagaaatcgtacagataccgtaccactgcaagcacccagaatcaaggccaaagggccctaccaaacaacaccatagatctatcttcaggaaaacattccctacagaagcaaattcaaaaaactggaagaagtgactatcacatcagatgtgcagttatcaatgtaggaaacatgaaaaagcaaggaaatataactccaaaggaataacataattctctagtaacagatcccaataaaaaacaaatttacaaaatcctggaaaaagaattcaaaatgttgatattaaagaagctcaatgagatacaagaaaattctgaaaaacagtacagagaaatcagaaaaacaattcaggatatgaatgagaaatttaccaaagagagatataaaaaagaaccaaacagaaattctgtaatggaagaattcattgaatgaaatacaaaatacatttgaaagcttcaacaatagactagatcaagcaaaagagaagatctcaaaacttgaagacaggtcctatgaaataacccaagcagtcaaaaagaagaaaaataagaaagaattaacaaagcctttgtgatatatgggacaacataaagtgaccaaatacacatattattggtttcccagatggcaaagagggaagggaaggttagaaaaatctatttgatgaaataatagacaaaaacttcccaagtctaacgagatttagacatccagatactggaggct

SEQ ID NO: 49365 - DNA, 324 bp, Homo sapiens
ctaatttctatgaggagctcatgcaaaccagacactgtactaggtgctttgcatatagaatctcatttcatccttgcaaaaaccttgtggagtaggcgatgttttacattttacaagtgaagacactctagttcagacaagctaagtctgtctgtagttcagacaagctaccctgcaagtgaaaagtagagggaatattacaatctagccttctctgattccaagtctcatgttctatctgctgtcccacatggcttcctcttgccctttgcagggtatcttacagtaataaagaaaagaatgccttggatacatggcaataca

SEQ ID NO: 49366 - DNA, 257 bp, Homo sapiens
gtcagatgccaccttcctgtcatggcctgaccaagtccttcaggttaactttcctgtaccctggctgaggaaggagtccatttaaatggttggggtgggggaccttcaattttatttttggtttacaatccagaatggccaaaggcctttcgcacccaggtgctgaggcatgggtcaggggctgccaggtgagcccccggctatgagcctcgggctttctaagcacgggtaccatatcaagttgtgcactaggtgct

SEQ ID NO: 49367 - DNA, 491 bp, Homo sapiens
ttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattc

SEQ ID NO: 49368 - DNA, 290 bp, Homo sapiens
tatgtgctaaattccctgattatgattttatgaaatcctatattttctgcacatttttaatgtttgattttgctatggactgtgcttatttcagattttatactcatccaagaagctaatgtcacaaatacagatatagaaccgaaagaacgatgtcagttctaaattgtttacaatactattccccttctttacttgtcatggcctgatctgttcaatcctgacacttaaattattggcattaatacatatagtggtaatgaataaattatatttaatacaatgtgtta

SEQ ID NO: 49369 - DNA, 206 bp, Homo sapiens
ggcctaatattttggtattcttatctataaagtagtagaatattatgggatttttattgttttttaagcaggctatgtaataggcactagctgctcttccatcttgtttgaggatattatataagtacacaacaaggccgttctacaatattctgtaagtcagacagttgtctttacttgaagaagagggaagacagtggtatact

SEQ ID NO: 49370 - DNA, 304 bp, Homo sapiens
actgctctaaaaatcactaagattctttttttctttcctttgattgagatttaaaaaaaaacataacatgtaatttatcctcttaacaaattgctaagtgtgcaggactctattgttaataatatgaacattgttgtagggaagatctctagaacttttttcaccttgcgtgactgaaactctctacccattgaacagcaactccctatcttccctatgccctattatcccctgtcagctactgttctactttctacttatatgaacttgatcattttaggtacctcatagaagtggaatcatg

SEQ ID NO: 49371 - DNA, 262 bp, Homo sapiens
ccagcgtccttccgcctgctccgccccttccccaggagcagcctctgcttaggtgaggctaagagcgcaggagcagagttctagcttactgtgtgaccttggagaaaatacctaatctctgtgagccccaaggcaaaatgaagagggtgtgagctccacagagggtaggggccaaagccctgggatgcaggtgagtaggtccacaacccgcaggtcttggatctcaattgcccaggaggggacccgagaccctaaagaccat

SEQ ID NO: 49372 - DNA, 468 bp, Homo sapiens
agcctgtctgttgaacataaatcttgatttttatgtaatcagatttttctccttacggttatgttcttggaattttatttaagaaatctttttctatcctgagaccacaaaaatgtccccaccattttcttctgtttcatagttttgccttgtatgtttaatcctttaaggcatgtgtagttcattttatatggtgtgaaatagttcttattcatttattcaacacatattggtggagtgcctgctgaaggtagtactcttcagagtactttgtatatatttgtgaacacatattcttgccctggaagcttatgttgtccttcaaggtagatccctactcggtttccacctgttttcttcagccctcaggatgaattccacaattttacacatagcaccagttaaggaataggctttattggagaaaaggaaggcttattagaccagcatcagcaagaaaaaaaaaaa

SEQ ID NO: 49373 - DNA, 356 bp, Homo sapiens
cggatttcaaaaacaatgaaaaaattgataatgcatttggaaattgtagaaatatgagagagtcctaattttgaaaatgaggcactctgatacaggtcagttgtacaaggacatgagtacattagtactttgataccttcatgtttggcagttatagtcaggtacttcttttatgaatttaaaattagtaatttattttatgaccaacttcaacttttcaggagctgttattgtgaaagtttttttgctactatgagttttatccagtcagaaacaggaaccaattgtaaacaattacttctattgctgcaaacaatttttaaaaacctgccaaatatgcaatgccttgctattca

SEQ ID NO: 49374 - DNA, 476 bp, Homo sapiens
atactaacccctcgtcagatgcatcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggtttt

SEQ ID NO: 49375 - DNA, 466 bp, Homo sapiens
tggggttacaggcatccgccaccacacccggctaattttgtatttttagtagagatggggtttcgccatgttggccaggctggtctcgaactcctgacctcaagtgatctgcctgccttggcctcccaaagtgctgggattccaggtgtaagccaccgtgcccagccctaaaacgtatttaaaatgttattttgttcccttaaaaatacttattatttttgcttagtgcaaagataatgtgtgtttatgatgaaaaccctgaaaatgtagacaggtataagaaatagtccattaactaatcacccagaaataaccattgctatgcattttcttttggccttttttctaagtacatatatttaaaaaataaaattagaatgctattgtattttttaacttcatgttttgtatcatgagcaaattccctcctaataaaagttatacatattttaacatacttttcctg

SEQ ID NO: 49376 - DNA, 495 bp, Homo sapiens
cagtatgtatagctgatcaccttgggctggttgcacattgttggataaagcaagattaaacaaggtattacaaaataaatgggaggtcagttaaagtacgagataggtttggctgggtgtggtggctcacgcctgtaatgcctgccttggcctcccaaagtgctgggattccaggtgtaagccaccgtgcccagccctaaaacgtatttaaaatgttattttgttcccttaaaaatacttattatttttgcttagtgcaaagataatgtgtgtttatgatgaaaaccctgaaaatgtagacaggtataagaaatagtccattaactaatcacccagaaataaccattgctatgcattttcttttggccttttttctaagtacatatatttaaaaaataaaattagaatgctattgtattttttaacttcatgttttgtatcatgagcaaattccctcctaataaaagttatacatattttaacatacttttcctg

SEQ ID NO: 49377 - DNA, 701 bp, Homo sapiens
cagtatgtatagctgatcaccttgggctggttgcacattgttggataaagcaagattaaacaaggtattacaaaataaatgggaggtcagttaaagtacgagataggtttggctgggtgtggtggctcacgcctgtaatgccagcactctgcgaagccaaggcgggcagatcacttgagctcaggagtttgaggccagcctgggcaacatggtgagacctcatctctacaaaaaatacaaaaattagccaggtgtggtggcgcgcacgtgtagtcccagctacttgggttgaggtggaaggattgtgtgagcccaggaggtcgaggctgtagtgagcagtgatcacactgctgcgttccagcctgggtgacagagtgagaccgtgtctcaaaaataagtaataaattaattaagtataagataggtttggggcaagaatagttgcaaggagtctagtgttacgcgtcaagtgtctgttgagaggacagtggcttggccctttgaaaattatttcctaagactcagtgctaaattacatttcttttaatgtaaattttcttattggcagtataacatacatacagaaaaattactagagtatcacatcatgataggtttttcacaaagtaaacatttcacacagtaaacaaagtaactagcgccccaatcagaaaaggtaattgttattaactccccagaaa

SEQ ID NO: 49378 - DNA, 382 bp, Homo sapiens
cgggccatgagggatggaggtgattaaagtatctctactcccggtgggtatctggggaggatgcggtcggtggttccatgggaaaggtttcagtagctgttgttttacttaaagactgctcttgggaatggctgtggaggccatttgagggctctaactggaaacagtggccatctaatctgcttttcctcttccccaaagttttgcctccctctttgctgcctcctgcctgcctgtcctgtttgttttctctttgcttagctctcttccttggagtggtactcccacattttcttctcttccataaaaaaatacaggtgggctgagctcactcctctaatcccaggactttaggaggctcaggtgggtggatcacttgagc

SEQ ID NO: 49379 - DNA, 495 bp, Homo sapiens
agtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttaaggagattaaatacaggcctccaaccacacaggccatctg

SEQ ID NO: 49380 - DNA, 591 bp, Homo sapiens
gggttgggggggtggtgcaaggcagggcatggccactcattgtggagcatctgcccactcaccgtgaaacccggattcaaactggcttcaattttaaggggactgtgttggctcatgttaccaaaaactcacagggttgagggcttcaggagaggcttgatccagcagctccacatgaccaagaacccatcttttctgcctcttggctttgccctccagcatgtttgctgatagcatggagggctctgacactccctcataagctctaggagtgccccctggtgtcactctaaataagcactggatctcagtaaaaagtgcttgctgggccgggtgcagtggctcatgcctgtaatcccagcacttcaggaggccaaggcgagtggatcgcttgaggtcaggagttcgagaccatcctggccaacatgactaaatgttgaaaaatacagaaattagccgggtgtggtggcacgcacctgtagtcccagatactctggaggctgaggcagaagaatcgcttgaacccaggaggcggaggttgaagtgagctgagattgcaccactgcactccagcctggatggcagagcgag

SEQ ID NO: 49381 - DNA, 663 bp, Homo sapiens
tgaatccgggaggtagaggttgcagtgagccaagatcgtgccattgcactccagcctgggcgacaagagcgaaactctgtcaaacaaaaacaaaaacaaagaaagaaagaaagaaaagaaaaatagcaagtaggttagtgtgactagagaagagtcagagaaagtaggggagactagtaggaaatgatgttaaagagataacagaaatccagacaattaaagaccttgtaagctattgtacagacattggttttcttctaaatgagatggggaaccactggagatgtttgagcagaggagagactttaatttaactttcatttttaataggaaaatctgactcgtgttgacagtagattgtggtagggggcagaggtataacaccagttaggaggctattgaaataatccaggcaacagataatgatgacttgaaccaggatggtagctgtgagagctgtgagaagtgggtgaattattgatatattttgaagagtaaataggatttttttattatttgaagattgaatgtgagaagaaagagaggagtcaagaaaataccaaagagtttggattctaagcaaaggatgccgtggccatccttatgaaaggaagcaactgtcatcaactgaaggctgtcagtaatataagttttcggatgtgt

SEQ ID NO: 49382 - DNA, 572 bp, Homo sapiens
tgaccacatttctgatctacacagtatgaactgtagtctggaatatgcacttctttgtgcctgactagcttcattcttctggtttctgctcttggtcttttggctggttcacattttgcagtctgctgtttatggatagaattactgaggcagaatatgtgatatctgaaggtagcagagacctgtaattttagttattgccttagctgttgggtagggatgaactagtgaagtgggtctgggtaggctggccagaactaaaaataatttggctataaggaacaagtttctatgcttgttctttgccttggtattttccgcttcttcagaatataagggccaactaccactttcttcagacatgctgcaacgtccgccatgcccagtcatgcctctgccaataggcagcactcccgcatgagacagaaaggttactgaagatactgcctagtggagtcccaggttgaagtcatactttgagctggacatagcagtgggcctgtgattacttgaatggctgtttcaacttcagaagtgaaagtggtaaaactgaatccaagagcaccttaaag

SEQ ID NO: 49383 - DNA, 1070 bp, Homo sapiens
gtaaaactaaagttgaaaagacagcccaggccaggctctgcagctgttaatgtctatgggtagaaggcaacaagtatttacaaaacagtatttaccaagtattataacagacatatacaaaatgccacatgatcttgtttaatccacacaataatcttgtgaaatagtgtctttttaataacagctttattgagatataattgacataccataaaagccacccttttaaaatgtacaattcagtaggttttagtacattcatagtgccatgacatcaaattagttgttatcactaattccagaacattgggttttttaaaaattttgatagagatggagtttcactcttgttgctcaggctggtctcaaactcctgagtaaagtgatgcaaagtgccttggcctcccaaagtgctgagattacaggtgtgagccatggtggccagcccagaacattgttttgagcagttttaagttcatagcaaaattgagcagaaagtacagagttcccattcattccctgcccccacacatgcataaacaaggatcagcatctccactagagtgatagatttgttacaatcaatgaactttcactgattcatcattaccccccaaagttcataatttacattagggttcactcttggtgccatacattatatgggtttggacaaaagtataacgatatgtatccacttttgtagtatcatacagagtggttgtcactgcccccaaaatctctgtgctctgcctattcatcactctctcctaatccttggcaacctggacttctccgtatttttgcttttccagactgttatgtacagtatttggaatcacacagtatgtagccttttcagattggcatctttcacttagtgatatgcgtttatgggtccccatgtcttttcatgtcttgatagttcattttttagtgctgaatgctattccattgtctgaatgtactacagtttatccattcacatgctgaaggacatcttggtggcttccaagttttgacaatcatgaataaagctggtataagcaaaaataaaaaaaaaagtcgcg

SEQ ID NO: 49384 - DNA, 540 bp, Homo sapiens
ggatctgtcctttgcggtgtccctccttgctctccagaatcttcgcttcaactcccatctaagatgaaaggagccaactaagctcacttcggggcagctggtcattgcctttagggaacacgagattagcgttgccagatatctgaccttttggcagaagttaaaattcttgatatttttgagaatcttctaattttcaactgttggcaacttatttaaaagattgttctggccaaatgaaacccattagcaggatggattttgcccacagaccactggtgactgatgacacattttcaagctttacccctcacgtctttctctctcgtttttttttttttgtttgtttgtttgttttaagatggagtttcactcttgttgctcaggctggagtgcaaggggacaactctcgggtcactggaaactccgcctcccaggatcaggcaatctctcctgcctcaggctcccaaatagctgggatcacaggcatgtgccaccgagcccaggtaactcgtattgtttgtgtagtagagatgggga

SEQ ID NO: 49385 - DNA, 391 bp, Homo sapiens
tacttgagaggctgagagaggaggatcacttaagccatggaggttgaggctgcagtgagctgagatcgcgcccactatacctcctagactgggagacagagcaagacccccatcttgcctatataaataaataaattatacatctatataaataaaccccccaaaataagaaagtaaatagaacataactgctacctacatcttaacatggctctgacgattaatgatacagtgcataaaagactgtttcagcaatgattagtgtataaaaaggatgtaataactagtaatattggccacaaattctattaatatgctttatatgtaaagatatataaaataagtaaggtattaagagaatacaaatatcaacttatgaaaataaaaaaaa

SEQ ID NO: 49386 - DNA, 1248 bp, Homo sapiens
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagaagagacatgaataaaatgggcctcaacaatcccaagaagaaccactcaaggacaatgggagccactgggcttggcttcctacttccctggaaacaagacaatttgaatggcactgactgccagggatgcaatattttatacttctctgagactacggggagcatgtgttctgaactttccctgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagagccgtggtttcagggcacttggggacatctgtggccacgttcatgaagaagactaagcctacttcatctcaggacccgcccaagagtggccgcggctttgggacacctgcggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgttgagtggaaccacgatgggctgaggccaggggagacatcacaacctccaacaacactttttttcatgctttaataaatcatttttcttagagaactaaagtagttgaaacaatatagaaacattttttaagtaggcataaaaaaaaaa

SEQ ID NO: 49387 - DNA, 685 bp, Homo sapiens
atttaaaataaaagaagacagaacagacaaacaccataagaaagctggtgtagcagtatcgatgacctgaaatggaattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagaccagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaaaaaaat

SEQ ID NO: 49388 - DNA, 405 bp, Homo sapiens
ctttggcagtactccaccagttttcttcactccaggctgaaaggtcaacttttctgggccatgctccctgctgggctggtaaaccaactttgagggagaagggggaagtccagatatgtagtgtttgctatttctatgatgtaaatgctcccacaatggccgatttcaagctacaaacagtccaacaagtggcttgcaagttcctggaaatttaacaattagctcctgtacatgactggcacaagctgctttccaaactcacattccgcatgcctcagttctgctcactttctattggtcaaaacttgctgtcagtgggtggggaagtgtacccctctcttaaaggaagccttgcaagtcttgtgacaatgaaacaggagagttccctgatttcctcccggcccc

SEQ ID NO: 49389 - DNA, 389 bp, Homo sapiens
tcgcttgaacccaggaggtggaggttgcagtgaaccgagattgcgccactgcattccagcctggtgacagagcgagactccatctcaaaaaaaccaacaaaaacaaaaaaatctcaaaatagctcataatgttttaagaaagtttacaaatttgtgttgggctgcagtcaaagccgttctgggcctcatgcggcccgcgggctgtgggttcaacaagcttgatttaaagtctgtttgctagtgaattttaaaaactttttggggtcacaaatagaaaagaatttggtttatttggtttatttattgcagagaacctggaacatacgattaaagcatgcctctatgtgtggggatttttttttaaacttcatgaggcttagactaaaaat

SEQ ID NO: 49390 - DNA, 280 bp, Homo sapiens
ctccattaatattaatatttttcaagtaaatcaaaacccagcaaaatatctgatgtttctttgcaagtttgaacaacaagaatatttcttatcttttattaaaagtaaaattgtattcttcttagggaatatgatactttagttatcaaaatgctacaaaagaagcactagtccatacacccaataataaactatcaaagttatattatcagattatctcatttgtcctaaaataaaaacacacaaatgcaatgataaattgggattcagaaactttttt

SEQ ID NO: 49391 - DNA, 456 bp, Homo sapiens
cagggggaagacagcatgagaaagttggaaccaaagtctgtattttgcagggaaaatttagcccttggagcagatgaacgtgtgccttcaaaagaggcagtgtttatatagactaggagaatccttgactctttcctttcactttctccctgtctctccaccatctacacacctagttacctgtgctggtttctttccataatgaaaaaaatagctaatacactttctgccaagcactaagccctttatacagattaaattactgtaaaattatcaaatcactctaaaatgtcattgttccattccattcccaccagcagcatcctagttcaggactgaataacaaactctcagttctctggcttcacattcccatttccatatgtatccagatgaatcctcttaacctctgctgcgacttccgctgcatgcaatcctttcacagatctccaaaaa

SEQ ID NO: 49392 - DNA, 449 bp, Homo sapiens
gaccacataaccaatttctgatctttgggcaattctattatggtttcaattttgtgatgtgctactgaagaaattgactgtgtaagaagcacaaagccaaagatgactcgcatacacctgccctgtgaagttgagggctgtgtggcctgattaaagaagcatgcatttggccgggcgcggtggctcacacctgtaatcccagcactttgggaggccaaggtgggcggatcacgaggtcaggagattgagaccatcctggctaacacggtgaaaccccgtctgtactaaaagtacaaaaaattagccaggtgtggtggcgggtgcccgtagtcccagctactggggaggctgaggcaggagaatggtgtgaatccgggaggtggagcttgcagtgagccgagattgcgccattgcactccaggctgggcaacagagcgagactccatctc

SEQ ID NO: 49393 - DNA, 573 bp, Homo sapiens
aaaactaatgttacacatatggtaaaaaaaaaaaaaatgttctttgtcctttgctatggttttaaaggaaaagcaggaaaataagaggcaaattcttcccctaaaaattctttaaaattcgaacattcattaataggcatttcgtggaagacatatgaatggccaatgcatgtatgaaaaaatatttaccctcccaaccaccataaggaaatacaaatttaaataacatcttgttgctatcagttgctagtcccttgaaagactttattgataatatcctgtggtgataaggggacaaagaaaatggcattcagatgtattcgtggtctagtgggccatgcccatcggggttcttaggtttagctaaatattcagattgacccacctgtcataagccacatctggcacctgttgctcagaagagaggtagctgggatagccagcatgctggcgggtgttgctcttcagtgggagcctgcgtgacactccacttagttgtccatacaaccatctggaagccaccattcttggtaccccaagatacaactttgctgctaagaagtgggtttgagc

SEQ ID NO: 49394 - DNA, 820 bp, Homo sapiens
  misc_feature (339)..(339): n is a, c, g, or t
atgaactgtgtcagcagtgttagcaaatggctgaagtagaacggagctgcccaggatgctgccctgtcgctggggaatctgagggaggctgaaagatattgtaaaagagattgaagggctggactggctggaggaatggtgccatcgcatccatgccacaatactccaggactgccctgcctttgtcaggacagccatcagaggcggttttccctctaaccaggatgggcatcactccttgggcttgcaagtcttacctctcctcatgcaattgcatgtccaaggcatgccctcaaggggactggtgctgatccagggtggcaaacccaaagtggggangaaaatgctgaatctcatcctctcagagatctgctgcagtcagcgactatactgaggtgcatgatctgagcagcagtcgctggttggggaaggcttcttttgttggagtggggtctccagccacagcctgagggtcctctcttggggatgctacccagttaattgggtcatcttcagcctccacccaaacttaggcctgtaggtccatcaattactatatcagcctcaaggactgaacaggtgggaggaaggactagtgtgagtgatggaagcagctgagctgaggagtgctggcacctgtgcaaatccagcaagaatgacatctggctgagcttcagtcattcacctaagcaccaatcgggggtcactcccagatctgagcaatgagggaaacttcccagggggaaccccgcacttgggtagacctgggggagcagccagaaggaaaggggttgaacctgtagttgattaagattcagag

SEQ ID NO: 49395 - DNA, 353 bp, Homo sapiens
atcccttcccaaatagagaggtcttcactccaatttccgtgttcacccctctaaaacagaagctgctggataccctcaattagcaagtttcctaacttcaaattgcaaaaggtctgcaccccagctgtgcccaccacagctactgtggtgctcccaggacatcttgcaatgttcgttgacatctgtctggagtctcaccagctgtgagctctgtggggcagggccaggagagctgtctctagcagaccaacagcacaccatatgtgcaggcttggtcaaagttttgggtaagaatgaatagtgagggccaggcgcggtggctcaagcctgtaatcccagcactttgggaggcc

SEQ ID NO: 49396 - DNA, 240 bp, Homo sapiens
gtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcag

SEQ ID NO: 49397 - DNA, 6272 bp, Homo sapiens
gttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcggttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggtaagaccaagaaaacaagagtacgtatacaagtgtaaaccaggccaccaagtggtcgggagctctggcttgcacccagaataaatgtattatactcaagtttaaacattatgagaaagttgtgagagtcatttctcacttatggcactgaaaaaaaaaaaagcacatcatggtatgaatgactcatatgcaaaagatgaaaaacttctcactaatttgcatgtcttaggctcctctttattagaaacctaaatgtaaataaagaatattttaggccaggtacggtggctcatgcctgtaatcccagcacttagggaggccgaggtgtgcagatcacatgaggttaggagttcgagaccagcctggccaacatggtgaaactccatctctactcaaaatacaaaaattagctgggtgtggaggcacacgcctgtaatcccagctactcagtaggctgagccgggaggatctcttgaacctgggaggcagaggttgcagtgagcttagatggtgccactgtactccagtctgggcgacagaacgagactccatctc

SEQ ID NO: 49398 - DNA, 728 bp, Homo sapiens
ttttctcttttttttttcttttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcata

SEQ ID NO: 49399 - DNA, 6172 bp, Homo sapiens
gttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcggttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcata

SEQ ID NO: 49400 - DNA, 6298 bp, Homo sapiens
gttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcggttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttctaaggcccaaagtaatggaggaaggttttcaacagcctcactctaagttcagcaaaccccagtacaaagattggcaagggccagtcatccaccgagaaggcttcctgggaggctggatccaagagcaggccctgccctcaagcacggttcagagctttcagatcctgccccctgggctccctgccatgaagaggacactgggaaaagaacccatggtgcatgaggtcaactcatagttcttccctttcttgctgggcaaggtaatgaagcacttttggccaatttacctgtaaaatgagagggttaatacctctaagcccctctttacataaactctaaaacaatgtgactatttccacctcttg

SEQ ID NO: 49401 - DNA, 640 bp, Homo sapiens
ccagattgtgagccccgggctagggttttctgtgctggagtatctaacggggcccagggcctttctgagagggatgagctcctggagagtgggaggtatagggagggatgatgagaggagatctcatgactctgcaccctggtaacctccccgatttctgtcctttcactggtgccatttctaaggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcata

SEQ ID NO: 49402 - DNA, 622 bp, Homo sapiens
cctctccttatgctactgtatgtgggaactgatggattatctgtgtctctatagaaataatagatattgattacagatcctctttcctgaacctttcgtgaagtattttttatatgacgaccatagtttctgaagcagagtaaaatgaacaagatttgaataggaccacactgattctccttggtgacatggatgcagggaggagaggcatctgcctctgatggcagtaatatctaacttctttcctgcctttcttttcttctacagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcata

SEQ ID NO: 49403 - DNA, 521 bp, Homo sapiens
ttttctcttttttttttcttttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtc

SEQ ID NO: 49404 - DNA, 5965 bp, Homo sapiens
gttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcggttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtc

SEQ ID NO: 49405 - DNA, 5141 bp, Homo sapiens
gttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcggttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggagttgggaaagttatcccaacgtcgagc

SEQ ID NO: 49406 - DNA, 292 bp, Homo sapiens
gatgccaggttctatttggaatttacatacaacctgcttgggtggagaagccattgtcttcagaaaccttggtgtaattgaattgatagttactgttgtgacctgaagttcaccattaaaagggactacccaagcaaaatcatggaattattggttataaaaatgattgttggcacatcctatgcaatatatctaaattgaataatggtaccagataaaattatagatgggaatgaagcttgtgtatcatccattatcatgtgtaatcaataaacaatttaattctcttgaa

SEQ ID NO: 49407 - DNA, 344 bp, Homo sapiens
agggtttcaccatgttggccagggatggtctcgatctcctgacctcgtgatccgcccgccttggcctcccaaagtgctgagattacaggcatgagccaccacggccggcctcaatttaaacactttaaactgttctcttgatgggtatcagacaacgtatgccaaatgttgatgtggagactgggatcattgcagatattgatggctccagcactgggcatttttaaagaaataatggtataaatgtgatcctattatgcagaagagggagaggattcgcttagggcttccagttaaaattcaggacacccagtgaaattggaatttcacgtaaacaatgacta

SEQ ID NO: 49408 - DNA, 627 bp, Homo sapiens
  misc_feature (1)..(1): n is a, c, g, or t
ngtcttcttacactgaagctgctgtgttgtctgaacagagcctcaattaagaagtgactgaagcttttcccctccctccctctcttcctttcttctttcctttcttctttgtttcaacagttctggggaagtactaaatattagatcaaaattaaaacctgatacccaccgtactgagtgtttgcttagaaagttcttgtttgtttttgagaagcactaggagttaatggaatggggtatttagtgggcctttggattctgtagactcctagctctctgcctcctatgtgtaaggccttggacatttctcttaacctctctgagactgagcttcttcacatgcaaatggactcatttaccttccaggagcacctctgtgggagggggatgcaccatgtgaaagaggtaagccctaaggtggaggcagaagcaagtggccaagggaatacaggaggctaattttgacaggaactgtatgggaaaaggtggcctttgtgttgagcctagtagaatgacttcaataggcagtttttattcattcattcaacaaaaatttattgagatcttattatgagtcaggcactgttctaagtgctggggatataccagcaaacaacaaaatagaaa

SEQ ID NO: 49409 - DNA, 335 bp, Homo sapiens
tggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccaggtgtgcggcagcaggtggctgc

SEQ ID NO: 49410 - DNA, 2648 bp, Homo sapiens
tggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgcccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgacaaacacaacacactaacacccacacaaaacaaaagagg

SEQ ID NO: 49411 - DNA, 2610 bp, Homo sapiens
tggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgcccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgac

SEQ ID NO: 49412 - DNA, 660 bp, Homo sapiens
agcattcatttgcattcatttgacaagtcctgctgtgttcctttacttgttctcttctgtattatgggcttaagggtcgcttatttcaacatcgctatattttccctgaaagctcagtaatgattgaatcacagaatttaaagagcttgtcgtataaatacatctaaagtgaaaaagatgaactttttccccagtgaatacaggcaaccatcaatcaaaggaatgcatcctggaaaagaaaggcacagggtaaagcctgcctcctttgcgggtcccatctgttcttgggaggacagtccccatgtattgctcctgggccctttgtggccgagcacgaacagctgtacatacaaaggaggctgtgtgtttgttcatgatgttggaaccggaagtggaaggggctttcttgtcaaagaaggcacatatgagtgccatagttacgggacaaaaatatttctcctggaaaatctattgaagcctttgtgcgatgttcagcagagtgtgttgggggtgggtgtgaatgtatctgtgtgggtgaaatgaggcaggagaatcgtttgaactggggaggcagaggttgcagtgagtcaagatcacgccactgcactccagcctacgcaacagagcaagactctgtctcaaaaacaaaacaaaaagaac

SEQ ID NO: 49413 - DNA, 473 bp, Homo sapiens
cataaaggggccctgtttaaaaaatttattatcccaggatttgactccctgggtcacttcagcaactttataaattgctgggtttttccatcatcttctagtaactccctttggaaatcttctaaattttccttagttaaaaccgtttcctcagggaacagctatgactaccccaaaaaaaaaaaaaaaaaaaatcacgttaaatagttgcatggttgcgggggtcagatacagaaagaaaattgtcttttttttactatgcatgttaatttttaataaaaatgaattgagacatctggttaaaactttgggaggtgcatctagaaaagttacaggtggtgaatagaagtttgctactcattactgctaatttaagatatataatttgatatattctgtttatttagtgtgtagtctttaaaatatgatcctctattccttttcaaaattccaattaggtcacagattttcct

SEQ ID NO: 49414 - DNA, 2674 bp, Homo sapiens
  misc_feature (1571)..(1571): n is a, c, g, or t
  misc_feature (1758)..(1758): n is a, c, g, or t
  misc_feature (2011)..(2011): n is a, c, g, or t
tttaaagatgtggctaactagctagtgatgcatgaacaattgttttagaaacctaccattgtggtcctgttggtatctaggaagttttttcatttgttggtggcaactgagtgatctgttatgtctacttttcctctctccctgtcccctcccccatcttcttctctctcttttctttctccctttttttcagtcaaggtagacttgagataggggacttgcatggctatagtagatcataatacatgaggccccccaaataagagagtgaaacattgtctgggatgtattttctgctcgaactcatcgtcatttttctgtgtatttcttacattagcccccagaaaagcatttttcaaagactttgagaaccaaaggttctctctgtaaggaaatgtgttaacctgatttccttgttctcatgtaattttctctcttaaagccataataatagtgtcagaggcagctttctagttagtgtgagtaatgtggttactgtattttctatttttattttaatgtgcttttcctgctgtggattttttttttctttcttgattttaaaaacagcagttgagtaaatgtggttatttgaagactggcgtatattgcatcttctctgagatgcaattttgaaggaaggctctgtgcacaataggcattttttttcagattccttagtaggataaataggagaatgtttggaacacagatcagtgacaatattggtttatggtcatggtaggtcaggcttcctcagagaaactgacaatagagtatcccataggttttgtctctagagagtctgttaatatgaagtctgtttattttatgatgtgttgataagaaaattaggtaaccagggaagcaccttaaattgctgcattcatttgcctctttttaagcatgcacacacattgagaaattttgaattaacaacaacaaaatacacttaaattcccctggaaagagtaattaagagctacttgtctctgtgctgtcatctctgccagaattagagttcctgctgagtatattccattgagtcagccatcattccatcaccagcagggattgcttttctgcttttccacgtattgacatgtgagggaatgtctgtcttgcagtagccatgggcttgtgccagattttgagatccatagaggcagttctgggagcttttcaattctgaatcagggttccaattcataatagctgagccagggaaaccgggttgaatctgtggccaaaaccgtggtaaaaaactttttccccctttcctttcttgcagtgctttattgctttaaaatatgagtgcctctgtccattgattctctggtgactttccgttggattcaaattgtggtctcttaggtgaaaaggtcagtgtgttattcattcagccacacatcgatggagattaactgagagcagtacaagacatttggatcctgccagacctagggcacctgaaggaagtttatttcttttctctctagcctttactatgcctgctgcagaagaggatggccctgtcttctgggagtaggggagggttttgattggctgtntgttaactgcctcaaatccatggccatagggcgagtaagaaccctggagaatcaaacatgtcatctttgtagcatcacctgatttagtgcttttcctcaggtctgagatgtctcagggggcctttttcccttgcagcactgatctttcaatgaggtgctagtgtctgtcctgagcaataacaagganaaaccatgaagtgtgaacagctcttattaggggggtaaatgtcattagcgcctttgtagccttctctgcaatctgaatgctcctgtcaaaagagcgacttactgaagcctcctttaaaatcacataaatggaatttaagatgctgaagttttacattttaattaagcaaggccattaactccctttacatatacacttttttgtagccagttatgcttgtatgccttataaggctattgaaaaattatccacnaaaattattttaaggatttgagaaatagttggttaactttaagtcaaagttttagatatagagaccctatactcatgtgcccaaccattgtaatatgcgtattgacgtatatgataggagaaaacactagcattttgagttaataagtaggtcagtttggattaatggaaagtttgaagcttagagtgtttaaataatgattttattcttttcaatacacaagtggaaatgtttctccagtctaaattccccctagtattctcctgaaacaaaatttttatatgcagatatttgcttcttttgcaagtttgagaatttcacagtaacttctggttaccctgggttgtgtcttgcagttaccaaaaaaaaaaaaaaaaaaaaaaatcacgttaaatagttgcatggttgcgggggtcagatacagaaagaaaattgtcttttttttactatgcatgttaatttttaataaaaatgaattgagacatctggttaaaactttgggaggtgcatctagaaaagttacaggtggtgaatagaagtttgctactcattactgctaatttaagatatataatttgatatattctgtttatttagtgtgtagtctttaaaatatgatcctctattccttttcaaaattccaattaggtcacagattttcct

SEQ ID NO: 49415 - DNA, 420 bp, Homo sapiens
ctacgagggggaaaaggctagcagtgagggagaggaggaggactgcaggcggaagagcgcgcggttcttaggatccccgactcagaagctctgcctggcctcaggatgtggcgagcctcaagagacggtttgaaggtatttgtgccaacgtgacccccagggagatttggaggaagctttctacgtcctaggaggctgagatcccacggagccggtttacggttgagagcagacagtttcgagtagatagcgctggaagagacacgaagaatctctcttgcttcttgggaacgcgataaccacattttcttttctctgtttacccccactacttaaaaatcagcaattccgcacagagcaggcagccgctttggttcgaatgaattaatttgcccaagacagcagccgctcttctgaagt

SEQ ID NO: 49416 - DNA, 453 bp, Homo sapiens
attaactctgttttaagaatgagctgattgtttgagttggttaagataagatcacctcaacatctgttggtgataactttatctcaagtgtatctttaaggaagtccatttcaactgaaacatagttaagtatcttgaactgcacagatatgctttcaactttgagctggaattagcatttttatcttctttgggaactggacacagagaaggaaaagaataaactttgtttactccttccagcccaaaccctccattaaaaatttttcttaaagtacaaaacgtttgaatgccccatgaaaacatctcaaatgattgtgctgggtgtgtaagcaaggcagggttttactgttttaaaaacgcacttgggggaaccttgaggagtttgcctttttataaacccctctgatcttctatgtgaggaaacggaggtccagtgagtgaaagtgatta

SEQ ID NO: 49417 - DNA, 359 bp, Homo sapiens
ttttagctgaaagggcagatgtcagctggtttgagcctgcctaggtgagctcaacagctttcaatggggagaagacttcgagtttctaggtgacagctgaatcctcactgggtgaatccttactggtggcccatgcccgaggcaccttgaggacaacatggaaagcaacccaggagtaagggcgaattaggtttctctctggtgctgagaagatgttggctgtggaagcagaggaagtgaatcaggatcatatggctgtggagtggcagtttgctgagggcagtgaagtacagacagaaggacagttttaaacaacaggaagtcttcattcccttcctgggtgtctttggtcatctggg

SEQ ID NO: 49418 - DNA, 354 bp, Homo sapiens
ttcaaactgcattccttcatctatcgtatacattccactttgactatttccaaaattgaaatgttgcctccaatatttacaataagataacaaggaaatgaacatgaccagatattaaccttcagcatttacccaaaagctgtgctttgataaaagactttatgaaacaaggtcttttaaaaatcaaaggggtgtgctcaagaatacgataaatatttggaatgctgcctgtgtggtatatttgtttaataaaatagtatgccagcctgagcaacatggtgaaaccccatctctattaaaaatacaaaaaaactagccaggcatggtggtgcacacctgtagtcccagctactc

SEQ ID NO: 49419 - DNA, 451 bp, Homo sapiens
gttttgtagctatggataattctaaaatgtatatggaaaggcaaaagagctagagtagctaaaacaattttgaaaaagaaaactaaaatagaggaaccatgctaccctttttcaagacagtgcaatactggtgaatggataaacacgtagatcaatagaataggacagagaaccagaaatagcctcacactaatattgtcaactggttttaacaaaggcgcaaaaggagaaaggatagcattttcaacaaatggcaccagaacaattggtatgatataaggcaggcaaaacttaagaacctctacttaaaactcacactttatatataaaacttaaagttgatcatagatttcaatgtaaaatgtgaaacttttagaaaagaacataaagtcttctaagatctaggctaagcaaagaatttttagacttgccaccaaaagcatgattcata

SEQ ID NO: 49420 - DNA, 451 bp, Homo sapiens
gatgtttgtcatggccctccttatattacaaacacttagtgagcacttgctatgtgccaatgttgtgctaggtctggggatcctaagactagaggcagaggcttgctcatacaaagattgggtcatagacagtaggcagagggtttcaatagagccagacagtcagaaatgagtagagatggcagctgtcaggagggccgcccactcagtgcagattgcagttggggctcactctcgtatatgatcacatacatcatttcaggtagtcttctcaaccaccccctcggcctagcaaggcaggtgttatcaatctcccctttgtagattaaaaagctgaagatctgaattgtttgatatgttattactcttattaataagatccattcaaaataaaacttgctgtcacaaatgtaattgcagcgaacatgtgcaaagatttagaccaagtaaa

SEQ ID NO: 49421 - DNA, 488 bp, Homo sapiens
tggactttaattcagagcatgaataagacaatcctttatcaagaccatttggggagaactttttaaggggaagatatcttcttctatcgtggcctcaaatcaggccatactgattttctacatgcactaagggtgtggagatgggggttagggtagcagggctacaagaaaggatcagcagctcttgtgcacatggaatgtctgaacgctgaaacagaactacatcactaccacacagccatgctgctctatggagaacttttatcttttgcctttcactgtgtttttatagtgttctgggtgtcataacttccttttgctattgcttttcctggaagtgaatgtgactttatccattttgcagaaaaaaaaagcctgcacaatgtgaatcactaggcaattggctgttagaagaggatgtacaacctattatgctataggattcctgccctcaaggaatttactatcatgcaatcaaattcagtggg

SEQ ID NO: 49422 - DNA, 246 bp, Homo sapiens
accttttgcaccagccctcttggtaccagagttcttgttcggtgtccgggaggaatcaggctgcatcagttaattgaagggtggtgaatgtggaggatttactgacgagtggaagtggctttcagtgggatgcggtgctggaaaggggatggagtggaaaggtggtcttcccctggagtttggctatcccctgctgacctcttctctgtggtcctaccgtcaagccgtccttctgaagtcccacct

SEQ ID NO: 49423 - DNA, 386 bp, Homo sapiens
ttttaaagaaagataacttaaataaaatttgaaaaaaattgcatttacagtaagcaactaaacaagtggtcttaatcagttcttgtttaaaatgaactgatgtagtctgcttcttcgataaataatttttgccataaatatgttggtttcaaaacaaagcaaaagtcaggagttaccaggtctcaagcactgataagtatagcagcagctatggttctagtgttattatccagaagattggagctcaataaatgtaagcctctgattgtgtttctactctgctgtatttatattcatcaaagaaaataaatacagtgaagtcatagatgaaaaaatgctaagcaaatacattattcctgttttctaccattattttgcagaatgtg

SEQ ID NO: 49424 - DNA, 1475 bp, Homo sapiens
tacaaaaattaagcaggtgtggtggcacgcgcctgtaatcccagctacttgggagactgaggcaggagaattgcttgaacttgggaggcggaggctgcagcgagccgagattgcgccactgcgctccatcctgggccacagagacagactccatctcacccaaaaataacgattaaaaaaaaatgttactgggtggttttatttaaataaattttgtgtatatttcaggtatacaacatgatgttttgggatgcatatagatagtaaaaaggtttctacagtgaagtaaattaacatccattgtctcacatagctattttgtttttgtggcaacagctaaaatctcatttagcatggatcctgtttacagtataattttattacctatagttgtcatgttgtacattagatcgttagacttgttcagcctacgtacctgttcctttatattctctgacctatatctcttcctttactaactcccacatcactgttttgttctctaattctgtatatttgattttttaaaaaaatttcacatgtaaatgagattgtgcaatgtttttctttcagtcctcctgactcatctatgctgtgacaaatggcaaaatattttgtttttttttttttttgagacagtcttgctgtcttagcacttgctctgtcactgcactcaggctggagtgcagtggtgctatctcagctcactgcaacctctgcctccctaattcaagcgattcttttgcctctgcctcccaagtagccaggattacaggtgtgcgccaccacgcctggttaatttttatatttttttagtagagacaggatttcaccattttggccaggctggtctcaaactcttgacttaatcccaaagtgctgggattacaggcatatgccactgcgcctggccaagatctcattcttttttagggctgagtaacatatgccatcatatatatgcactgtagtttctacagtttatccattcatccattgatgatggacagttaggttttttctgtatcttggctattgtgaataatgttccactgaacataggagtgcagacatctttatgaagtgatttcatgttttttggttatatgcccagaagagggagtgctgggttatgtggtggttccatttttaatttctttagaaacctcccagctgggcgcggtggctcatgcctgtaatcctggctactcaggaggctgtggcaggagtatcgctcccgggttcaagcgattctcctgcctcagcctcctgagtagctgacattataggcacctgccaccacgcccagctaatttttgtatttttagtagagatggggttctcaccatattgggcaggctcgtcttgaactcctgacctcgtgatccgcccaccttagcctcccaaaatgctgagattggaggtgtgagccaccgcgcctggccagtgtgtcctttcttaattgacagtgacat

SEQ ID NO: 49425 - DNA, 1401 bp, Homo sapiens
tacaaaaattaagcaggtgtggtggcacgcgcctgtaatcccagctacttgggagactgaggcaggagaattgcttgaacttgggaggcggaggctgcagcgagccgagattgcgccactgcgctccatcctgggccacagagacagactccatctcacccaaaaataacgattaaaaaaaaatgttactgggtggttttatttaaataaattttgtgtatatttcaggtatacaacatgatgttttgggatgcatatagatagtaaaaaggtttctacagtgaagtaaattaacatccattgtctcacatagctattttgtttttgtggcaacagctaaaatctcatttagcatggatcctgtttacagtataattttattacctatagttgtcatgttgtacattagatcgttagacttgttcagcctacgtacctgttcctttatattctctgacctatatctcttcctttactaactcccacatcactgttttgttctctaattctgtatatttgattttttaaaaaaatttcacatgtaaatgagattgtgcaatgtttttctttcagtcctcctgactcatctatgctgtgacaaatggcaaaatattttgtttttttttttttttgagacagtcttgctgtcttagcacttgctctgtcactgcactcaggctggagtgcagtggtgctatctcagctcactgcaacctctgcctccctaattcaagcgattcttttgcctctgcctcccaagtagccaggattacaggtgtgcgccaccacgcctggttaatttttatatttttttagtagagacaggatttcaccattttggccaggctggtctcaaactcttgacttaatcccaaagtgctgggattacaggcatatgccactgcgcctggccaagatctcattcttttttagggctgagtaacatatgccatcatatatatgcactgtagtttctacagtttatccattcatccattgatgatggacagttaggttttttctgtatcttggctattgtgaataatgttccactgaacataggagtgcagacatctttatgaagtgatttcatgttttttggttatatgcccagaagagggagtgctgggttatgtggtggttccatttttaatttctttagaaacctcccagctgggcgcggtggctcagcctcctgagtagctgacattataggcacctgccaccacgcccagctaatttttgtatttttagtagagatggggttctcaccatattgggcaggctcgtcttgaactcctgacctcgtgatccgcccaccttagcctcccaaaatgctgagattggaggtgtgagccaccgcgcctggccagtgtgtcctttcttaattgacagtgacat

SEQ ID NO: 49426 - DNA, 307 bp, Homo sapiens
gtatattcatgtctggaagagggactcacttaagctaaactaacaatagatttataaactagattatctatgtattattaatttataggcagattcagatgtagctaaaaagccacatctgataaccagtaagtggcaatcccttaactaaggtttagacttattggagaaaagctgagatggagcagaaggttatttgatgatgtgctatctgaataatcaaaatgagatgaccctaaggcagtggtttcaaccaggggtggttttggctccaaggaggcatttggcaatgtctggagacattttt

SEQ ID NO: 49427 - DNA, 1311 bp, Homo sapiens
caaagtgctgggattacaggcatgtgccgcagcacccagtctggattattgttctttaaaagaaacaggtttgttaatcttatgggcagcctgcccaggggctgccacaggaagacaattattagtgactgccatttgttgaaatgactttgcaagcagtcatacatggaggtggaaaaagagaaggaaaatattttatcaaaattcgggcccctaccgtaattttaatcttgagggtgtttttaattttatgagggaggcttcagcaggagtcagcaagctacacccataggccagatagacttgcctcctgcaatacagtagttttattggaacacacatgcactgaaataagatttgatttcatggaatagccaagaccttgttttaatgagacagtagacttctgccttcgaagtctcatcccaggctcttttatatcagattgcgttaggtttaaaaaaggttgcaggtagttgaagaatctcaggtaataaggtatctctcccaaccaaaaaaaaaaaaaaaaaaaaattctttacagcagttgatacactgcttgagagcttgagagacttcatttgataagattaatttttatcagggcaatatagatttaatgttttaccttgtagaaaaaagtagtactttttttgaaggaatctctaaagttgcagggaaagattaataaccaattacatgccaaacagaaaagcctaataactgcctcttccacaagggaaaaatctgaatatgagacagtagctgaaagtttcttgaattcaccttgagaagacttaaaacatatttttaggatttatgctgaataaggttcaaggaatttgaatgaatagaaaggagaaagtaagtttgtaggaggataggataggtttgtgcgatagatctattttcagaaacattgaattttgattgtcataagcataaaaaggttggaaaatttgttttgtaatgacttaatggcaatagtaattcctgtcaattagttattagattttcaggaaacaccttgtgtcaagggttaaattcagcttattgtatttagtagaagcacaaaaacaagttgtgtaatctcagaaagttttagagcctagaaagttctacgtttagctgtagaactttcagattagaaaatttgacctttaatgttcttggccgcataccagtcacgcacttactgtatgttccaaagaaaggaatcctgctgttaacaggaagtctttagttggaatactaaaggcagactgaattcctttgttttgcgcttaaattttagttctgtctcaaaaacat

SEQ ID NO: 49428 - DNA, 542 bp, Homo sapiens
caaagtgctgggattacaggcatgtgccgcagcacccagtctggattattgttctttaaaagaaacaggtttgttaatcttatgggcagcctgcccaggggctgccacaggaagacaattattagtgactgccatttgttgaaatgactttgcaagcagtcatacatggaggtggaaaaagagaaggaaaatattttatcaaaattcgggcccctaccgtaattttaatcttgagggtgtttttaattttatgagggaggcttcagcaggagtcagcaagctacacccataggccagatagacttgcctcctgcaatacagtagttttattggaacacacatgcactgaaataagatttgatttcatggaatagccaagaccttgttttaatgagacagtagacttctgccttcgaagtctcatcccaggctcttttatatcagattgcgttaggtttaaaaaaggttgcaggtagtttaaaaatttccgggtattagggttttttccccccccaaaaaaaacccaaaaaaggagggggaaa

SEQ ID NO: 49429 - DNA, 2415 bp, Homo sapiens
agcggagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataagaatggaatgttgctttcttgcaataagtaatgttctttctgcctttttttcacttttaagtcagccttaaacacatgcctcacaaacatctactttctccacatacctttgagagagacactgaattggcctcagctcagttttgcataagcttagtgccagaaccagcacctgatgcttttcaggtgaaaataaaacaaacagcttctctaaagcatcttacccctgtgctggaggtttgagggacctcttcagtgcctgccccttgagtctaatggtcaccacctcattctgaagtatgagttgaattttttgccctctttgcatatttacattagtcatcactttgaagcaatgcagtgtgctggaaggagcactatctgcctaggtaactgctagtcatgacttggtcatcagcttgctttgtggcactgagcaagttacttcacttctctgagccttggttttatcatagggtgaggaggttggatacaattagtgccctcttaaccctgcagactcaatgttcccttttataacaagtattttattctgaatatgaaatgaaaattaaagttaatataatcatctatgtgcatgtataattttaagcagtgaacatagtaccctaactataatataaagcagaaaaaaaggcaacttttaataaaataaaatgtatttcaataaaaaagcttgggtataaccaccctagaagataaaattaagtcattagatgg

SEQ ID NO: 49430 - DNA, 621 bp, Homo sapiens
agcggagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggcttttgtacggtggccttgcatagtgacaattcatcccaagtgtttgattcacaagttcgagaacatttataaacccagagattctataaaaga

SEQ ID NO: 49431 - DNA, 370 bp, Homo sapiens
atttaatttgacatttaacttatattatatatatatgaactttgttttgatgtgtgaaatgagcgatactttttctccaaatagctaaccaattccaaaaccatcagttaaataacttatccttttcccactgatttttgcttcttcttacatatattttcccttgttggtttattctttcgtcaggaggcagtgaaactttggggagaaaagataacaggcttaacactgtaactgctgaatttaagatgtttatgaatcattcagatggaaatatatagtaggacacaatagatataggtttcttgcctaaaagagagaggggagctttatttgagggtaaaaagattactcaggggaacacaggtaa

SEQ ID NO: 49432 - DNA, 378 bp, Homo sapiens
tatgaaaaggatgtcactgaaggtagtaacacttcatgccacttgctttttactttcgacattgcttctaagattcatatacatcggcctttcccaaccagagcccctcatcttgaccacagaacacagaaaataattggagtgtattttctcagtcctccaaacatgatacataaatagtctcctaaattttagatgcataagggagaagttatctcgttacatacaatggatgccttaggctgggcatttggagcttaattctctattggaacctggttgagactggccgaattgttacatgtagctagagttaattcatttttactgctgtaagatatcccatttgtgagcacactaaagtttttttcatatgtc

SEQ ID NO: 49433 - DNA, 278 bp, Homo sapiens
ggggataaatggatgtagtaccctaattatgagcagataactgctaattccttccaaattagctaattcccatagtcacatatgaaagtaggaacacggggatatacaaataaaaatgtatcaggagttaccagagtacagggaacaggcacgtgcttaaggtttagacctgtgagcactagttctttttaaggcttcatggagttaaaactagctgatgtacgatgtgtgtaaagattcggccagctgaaagaaaggaatcctagcaaggggcatca

SEQ ID NO: 49434 - DNA, 586 bp, Homo sapiens
ccatcacactctggactatcctcagcaagggaaaaagattttctagggaaattacatttttggaaacaaccaaaagtcagcataaccatgactgcagaataaagtagttgatgaaggtaagtgaataggggtgggaactatatttgagggccaagtatatagtgatccagagctaggtgtgtatatacaatttcatttaatcctctcaaaaagacagtttataggtgaagtgacttgcccaatgtcatgcaggcagtacataataaatattgggtttgaattcagccctatctgattcctaagcatatgctattatctgattccacatccttatatctaactcctaagcatacactatttctactatgtttgctgtttcctgagaaatcttaaggaaggagttactggagtactcccttaaattccagctccctcttttgatccctaaatgaaataggaaagcataaaatgactaatgttgttgacttcctactgggccccgcctctgctaggtacaagttatctaatttaattctgataaaaatcatgtgaagaagatatatccatccccattttcagatgagaa

SEQ ID NO: 49435 - DNA, 1241 bp, Homo sapiens
gcctctcccccacacagctggttttgatttggttcctgtggaatatttttgttttgttttgttttgcatttaacaacagtcagatatttatgtacagcttcatcaagagcctctgatgacaaatatgcctttggaggccagcagaagctgtgggaaacccccgtgtcagcactcagacctgtttccaatggagagaaatcgctctggggactgaactagcctgctcatgaatccagttcccttttcccagagccttctgctagctcacttccaacccatgctggccatcctgggactgtgccctgccttgatttttccttatgaagcaatccctcaagacacagccttggccctctctcctgagtgagggaggaaaggcagaaacaggcagaaagccatttacttcttagattggaaactagagcctggtttttgaaataaagcttggcagtatctcacttataacttactttataaaatgtgtaccttttatttgctgtcagagttatctacatgaatttgagatgtttggataaatcgttattggggaaagttgcaattggaaaatagacaatgaagtctgggcagagttccccacccttcggaaaagagtctcggatggtataatccgcttggagaagtctaagggagaaagaaggggggaaatcataaatgctgaaagcaaagcaaagacagctaatattaggaaacagaacatgggaatccagtccttcttacattgtactcctggttccgccagtgttctcatgagtgaccttggatgaatccttcagtgtcctgtgcatgcttccccacttaaaatgagaggattgaatcatgtgaaattctttttttaagcctcctttctagaaaaaaatgaaatgcttttcaactctaatttagtgattttgattcaaatataccatgtataaccaaaaaggaaaaagatggataatttttacataaaagtgtttaaaaatatatcaaagtacttactttttatacattttataaatattctttggtatctattatatctagctaccattgccagaaacaactttttgcagattttgagatttacatctactttgagccttaatagaacattgcttatactttgtattgatgtgtgtcactgtacgtataaatctttttgacttctttataaactcaaatccaccctggccataactgggtatgttcatgaaacatgctactcactacccctcagtacagct

SEQ ID NO: 49436 - DNA, 471 bp, Homo sapiens
gaagtgtttctgagacacaattcataagtttctgacagcagggcctggttaaacgaaccatggagctgtcttgctgagaacagcactgcccacgggaaagtggacaggtctgtgcgcttgtgaagggaacaggtcacgtacactaaaggggagcgcgggctccagggaggattcctgagtattcccattcatgtattctctctgaattgagtacccatacacagggtgtctgcaaagttggaaaccaggacacacctacttttaaactgttagttacattttcaaatgctatattcaacgtgttttcaggcgaatacctaggtaatgagtataattattaaattgaaaaaaggtactaaagacagagtgtccaaaaatctagaaacactggaaaaaatagtccatttatagcacgttttcatatgagcaattggacgtttgctttaaatttaggtatctggagactgacca

SEQ ID NO: 49437 - DNA, 581 bp, Homo sapiens
ccaccactgcgcccagctagactttagtttttatagtgaggcttgagatttgcatctccactggtctctttgacatctcagaggatccattctgaacttgctaggtttctttcccctgctgaattgagttctgcatcttgagtctgcagcagtgtgaatcctatctttggctccatttaacagcctatggacgttcccaaacttgggacccagtttgtctcttcatgatagacaaatattattttcagaagtcattctaatcgcaccactgcactccagcctggcaacagtgagactccatctcaaaaaaaaaaaaaaaagtcattctagtgggtgagatttctgccagcattgagccactgctcaacatattcttgataatggtctctgaacagcatttgattttaccttggagttgcaaagtcaaagtctaactcgccaaacaaactcagtgtggaatatacacatttgtctcattccggttttaaggagtttagtataccagagcttttgtgacctctaaaaagcagttatcgtccatgacaagaattggctcgttcaccctcagtactctggcttac

SEQ ID NO: 49438 - DNA, 955 bp, Homo sapiens
aggattctcgcctcacagggtcattccctttgcctttccaaacatgcccattgccaggagagttctggcaatttgcagttgggtgttgagtaatctaaaattgagagactgctagggtttttgttgaaatgatattttaaaaactaaatagggaatcccatcgagagatagtagaaaggcaaattaacattttaactcgctcttctaggcttttaaaactgaatgtacttagataatttgttcactccttgtaactacaacagcctattagaaattattttggccagatcctggctggattctgtagctacttgcatgtgttactctgactcttactgtctttatgtagtcccttctgccttaagatctatctgctttttgcttgagactgtcctgagaccagcagtctttgacgagaagagtatttgtggctcttccctcctgggcttggagttgtatccctcataacaacggggttatgccgtgtggggatggcggcgcagacagccttccataggtggtaaactataactgtgtcatttgtgactgacagaacaaaagggctttgttgccactttaattgttgattaatgatgatccctctcaaatttgacacggttgctttctagaacacaaaagaagtcaatgtcagatgtttccttgatcatgacagtcatgattttcaggcagtcttggttctctgacatttcaggatgccatagaagatttcaagaaacataattgaataattttattaattgaataaaaaactgtactgcatattacttttcatactgtttgtgcaggatgtcaccagctacctgagatttatatgcaccaagtcatgttttatttgggaaaaagttcatatcttgtagatatttagtgctattatcttcgattttttaatttttttcctcctctttcctacccccctaatccttccctggaatta

SEQ ID NO: 49439 - DNA, 758 bp, Homo sapiens
aagatgcaaggaatctcagtcctcccatggaccatggaggagaaaggaaccagaaaatagcaaacaattaatatctgccacggcacgcgcttccttatggcaacaataggctggagcccattagaagctgccccttgaaatgggacttaaacacccagtttgacagtctccacccagcctgcctagcccttgggggcatttgattttgcaagtcctggtaaagataaagccaatctcaatatcagtctttcagatgtccctggtgatccgtggagttatcacacagttttcaaaaacaaatgttttgctctgcttgagacaaaaacttatgacatgcagaattcttacaatgaaaagcaggatggtatcatgaaatcaaacatgaagttgaaactagctgttattgtagtctgcaaattacataaacctgtttatggtgatttcttcctgttgctcttccctccatcaatcaaacacccaccaggagaaacaagcctcccaagctcttccctggagtggtagtgacttgggaaggggggcggggggatgtctaatttaacattttgaagcatttatatatatatatgaatatacatatatatagatgtgtgtgtctatataaatattcaaggctaaaatatttgagaagaaaacttgtgagctaggaatgggaaggcttctcttccaatgaccaccaatgagaatgttataaaatatgtctaaaggtttaagaataaatcagcatccatacaaatgca

SEQ ID NO: 49440 - DNA, 457 bp, Homo sapiens
gggcagaagtgcaattcctcagagccccaagacgctgggcagagttgacaggacccaaatgctaaagttgtggagggaaaggggagtttgggaagaccctgtcctgagccctaaactcagcacagtgcattttcttaccaacttctgaatattcatctcaggctggattctgcacccgaggagagccaggcacactccaaaactgtcacactgccgatggtgcgtggcacagccagcttcctctctgtccctccatagggcctgtgcagtcttaccagcctggggaacggcattctcagcagcctgcacaatggactgtattaatcacgtagaacgagagggaaaaagaaagctaaatttctattagcataagaaatagaatcttagagcattccatctccaattctctagcaggatagagagatataatctaagctctgaacagcttctttctagc

SEQ ID NO: 49441 - DNA, 623 bp, Homo sapiens
taacttttcttataagcctgattatttttaatttgtgattttgcagaactaaagggttatttaggaatgtgtatattgcattgtactagaaatgcttgtattatccccagttacaactagtctcttagttgtagttggcaaaagttcaatttagctttgattctgtcacccagaatttttcagtatcaaggaacttcttccatctcaacccatttcagaaatcaaaatgagtggagctacagcatgtggcaaaaggaataatggataaaataattggacttcatcaaaatgaactcttgtgcatcaaagggcatattaaagtgaaacaacaggccgggggcggtgactcacgcctgtaatcccagcactttgggaggcagaggcgggtggatcacttgagggcaggagttcaagaccagcctccccaacatagtgaaaccccctctctactaaaattacaaaagttaactgggtgtggtggcacaggcctatagtcccagccgctctgggcactgcagcagaagaaaggcttgaacctgagaggtggaggttgcagtgagctgagatcatgccaccgcattcaagcttgggcaaaagagcgagaccctgtctccccccccaaa

SEQ ID NO: 49442 - DNA, 614 bp, Homo sapiens
taacttttcttataagcctgattatttttaatttgtgattttgcagaactaaagggttatttaggaatgtgtatattgcattgtactagaaatgcttgtattatccccagttacaactagtctcttagttgtagttggcaaaagttcaatttagctttgattctgtcacccagaatttttcagtatcaaggaacttcttccatctcaacccatttcagaaatcaaaatgagtggagctacagcatgtggcaaaaggaataatggataaaataattggacttcatcaaaatgaactcttgtgcatcaaagggcatattaaagtgaaacaacaggccgggggcggtgactcacgcctgtaatcccagcactttgggaggcagaggcgggtggatcacttgagggcaggagtttgagaccagcctgaccaacatggtaaaacctcatctctactaaaaataaaaaaaattagctgggtgtggtgacgcgcgcctggtattctggctacttgggaggttgaggcaggagaatcgcttgatctgggaggcagaggttgtgatgagctgagattgcgccactgcactccagcctgggtggcagagcaagactgtgtctca

SEQ ID NO: 49443 - DNA, 1208 bp, Homo sapiens
agcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcaa

SEQ ID NO: 49444 - DNA, 600 bp, Homo sapiens
agcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactcgtccagactcaactcaacctactatcccaaccacatctcccactacacatcacacaccctacatgtaccacaccattcaccacatatcataccactcccccgcaagaaataactcccactacacctctcacttatataatcacctcataacccaacactacgaaaccgcactaaacacacctcacctcacccacccgccagatactaaaccaacaatgtacacgcccaccacagtccctacaatctccc

SEQ ID NO: 49445 - DNA, 235 bp, Homo sapiens
aatttcagatacctctccatgcaaatgtccacacagaacaaatagaagatgaatatgaatgctgtcagaaatactttgcatgttcaaaaggaatctctgagtagtattttagacctgaagggacacctaaggctctttggcttttgcataaggcagggctagactgtaaactcctggagggaaggaccacgccttagttttgtttatacattcccccaccccctatcttagtgcc

SEQ ID NO: 49446 - DNA, 2922 bp, Homo sapiens
tgcagcctgggctctgtgagactgaggtggcggtcagccggagtgagtgttggggtcctggggcacctgccttacatggcttgtttatgaacattaaagggaagaagttgaagcttgaggagcgaggatggcagtcaacaaaggcctcaccttgctggatggagacctccctgagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagttcacagctgccaatgagctggcctgccgaggcttggaccacctggaggaaaagatccccgccctccagtacccccctgaaaagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctgcagacaaggaagagtcagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctgagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccccgctgtctcctcaaccaaggggagggccatgtccctatcagatgccctgaagggcgttactgacaacgtggtggacacagtggtgcattacgtgccgctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcgtgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaaaaagtctagt

SEQ ID NO: 49447 - DNA, 143 bp, Homo sapiens
tttccatggaaagctggaacaacgcccgctgacggcaactttctaacagtaacttccccgacccagacaccacaaagctagcacaacggagctcagatgcaggctaggactcggtccatgcctcaggaaccagagaaagccat

SEQ ID NO: 49448 - DNA, 245 bp, Homo sapiens
ggaactctcccatcctggaagggctggtggttcacttttcacaagaatagtctcatattccagatacgaggcttgtcttttcctactcacaagtgtcagccagaaaggcttaaggagtgtttgtttcactgacataagcacacaacatttcaaacgagattcactttatagccaaggaagtgtagtgtccatgggccctcctgcctggcagagcgctgagacagcatgctaaaggcacagcctcc

SEQ ID NO: 49449 - DNA, 428 bp, Homo sapiens
tcccctacccatctgccaccaccacctgtgttcacagtctaattttatgcattgcctttaattgtcacatttccataatctttaatcttgaggattctacaccctttgtctttctatgcttgatatttttgaagagtataggcaagttattttggagaaaggcattcatttggagttgtgtctgatgtaattcatgtgcgggttcacattatgcattgttggtagggataccacagaagtggtgaattgcgggttcagattatgcattgttggtagggataccacagaagtgctgaaatgtccttttcattgcaacataacagggtccaagtgatgtcagtttgtctcttcattggtgatctcaaccttgtccacttggccgagacgctgtctttcagatttctccactataaagttacttaaaaaaa

SEQ ID NO: 49450 - DNA, 239 bp, Homo sapiens
  misc_feature (176)..(176): n is a, c, g, or t
ggggtttcaccgttttggccgggatggtctcgatctcctgacctcgtgatctgcccgcctcggcctcccaaagtgctgggattacaggcgtgagccaccgcgcccggccgggctgtattcttacactgactgtatagaaagaggagatagagtaaacctaccccgtatacttcagnccacgccctgtgcctgttctgtattatgaagcggggttgggggcggtgcagacatagaaaaag

SEQ ID NO: 49451 - DNA, 527 bp, Homo sapiens
aatagaatcgagctcggtccggagaacttacgtggatagagtcttttcatgcaagatgaacattggtggcaggagctagaggctcacgtgcccagagaggctcagcaggtaacatacatgagcaaagtggaaaggctgaaaatgaggtgaacaggagagctcctgttgccatcgaaaggaagcagtcaccactcagcctaagttgattgttgctaaaatttgctgattctttgaattttttttcaaaagatgctgaaaatctgaattattatacaaacttccctgttattaaattaatggaacaaatgcaagatattttaaagatacaatgtaggccagacaacagagcttcaggcaaggtctggacacagcttccagttttcaacttaaaacccagccttttatttggaatagtttcaaacttataagatgtccccaaaatagagaaatcaaggaatacctatatactccatatccagattcacttgttattaactttatactctgctttatcatttgaactcctt

SEQ ID NO: 49452 - DNA, 893 bp, Homo sapiens
taaacatgtagctactgatatttttttttgaaggtgaaagctttatttaaaggaaggtctcatagagagttttaaaattttagaatgaaaaaaggtcttaaatttattaaccaaatagtaaactaattcattcaaccaaaagacttactgaacactccctgagtgaaggtgtgtgtgttaggaaatgtgcttactgggtgaacacaacagaggtgttccccacctcatgatacccacagtctagggagtgacaggcaataattaagtaatttttaaaaatttatagctgtaaagtaaagcaaactatggcacgtccatgaaagagaggttagagcctatgagcggggaggcggggaccagatggagcctgggctcaggggctgccagacacacacagctgcctacgggcaggaaggggccccattggaagcgttaaacaagtgtctgtatagaaggaaggcatgtgaataaagaaaaaaagattgacctttgtgagttgtgacatccaaggtgtccaggaactagtttctccactttctttttctcctttttgtcatggccggcagttgggcccttgtactgttcatcagcttcaccatcaaaatcaaatgaaaagaaagagaagggaatggaatgctcactttctagaccttactttaaattctgttgaagatttattaatatttgggagagagtttgaaatgataatccaaaagatgtctccctttgaacatatgtagaagttaatcatttagattaacttgcatttaaacacataattgtatgtgatcgtatacattttttggctcactgttttgtgttcaaaggcagatttcctagggtagtgctgatttattctacttcttttaggctgtgtaattcaccttttttct

SEQ ID NO: 49453 - DNA, 377 bp, Homo sapiens
caccaaatggcctgttttggtagataggtgtcaatatcatcattattaaactttttctcttcgatatctgctagtcacctcacactttaatatgtcacaaatcaaattcccccaaggagagaaggatctttctctcctagtctttcccagtctcaatatacagcatctctgtccctatgctctagccaaaccctggatttgaccttgacttctctttttcttataccctacatccactccatcaacagttcctgtctgcttcagccttcaagaacctaatcaattctcactatctccaccactcctaccctggtccaagccagcatctcctcttatctgaaccattgcagtagcatcctactagcatcctactaccc

SEQ ID NO: 49454 - DNA, 489 bp, Homo sapiens
gccactgcatgggctgccattccaccaccagtgcctccctcagtgtcactttcctcggtggggaaggatgggtttatggttcttgtttcctggatgttgctgggcttgctgtccttaaataaaagcaaaggatttctccaggattttaaaaccatttagactcacctgtgattacggtgggagtttcatttcagaatgtcttgaacggtcccttctagttggccatagttctgcgtgtttgattgtatcatgaatggggcactcaattaggagttttacttataaaagggaagtattggggattgagggaatgtcttttttgtgtattgttttggttgccactgaattggtttatagtttctgtactttaattccttcttgccagtgatgaccataccctcctgcacacggaagttcttcttcataccggattttaggatatttacaaaatagtgaatggccagaatattgctatagttcattcaggga

SEQ ID NO: 49455 - DNA, 537 bp, Homo sapiens
ttttatatcacaaggtagtgtctctgaaaaatggtagatgatttcaatgtccacaaatatgcaggtgtagacattcaattgaggtactgtacccaaggcagccagcaaaatgctgaacatagaaaataactttgtaaacaaaatgcaatatttctagacagtgagttatcaccagtgtgctgcctatgaccctggccttaaggaaaaagtagcagagctgaagaagttctaaggatggaaattaaaaattattaaggagataatagacttcgtgttataggaaataaaaatagcaagggtcttcaatggtgagtgattttgagattaattacataactatgaattctgtaatattagaactaagctttacaaagcattccttaaaaaaagataattttacaacaaaggtaacattagacagaaaaaaatgtacaaaactaaaattaagtgattaatgcttgggaatgtttcctccaatgttcatctagtcatggttttcacgaatcactcttgccaataaaaccgaaaatcaaagta

SEQ ID NO: 49456 - DNA, 632 bp, Homo sapiens
ttttatatcacaaggtagtgtctctgaaaaatggtagatgatttcaatgtccacaaatatgcaggtgtagacattcaattgaggtactgtacccaaggcagccagcaaaatgctgaacatagaaaataactttgtaaacaaaatgcaatatttctagacagtgagttatcaccagtgtgctgcctatgaccctggccttaaggaaaaagtagcagagctgaagaagttctaaggatggaaattaaaaattattaaggagataatagacttcgtgttataggaaataaaaatagcaagggtcttcaatggtgagtgattttgagattaattacataactatgaattctgtaatattagaactaagctttacaaagcattccttaaaaaaagataattttacaacaaaggtaacattagacagaaaaaaatgtacaaaactaaaattaagtgattaatgcttgggaatgtttcctccaatgttcatctagtcatggttttcacgaatcactcttgccaataaaaccgaaaatcaaagtaatctagtgagtgtaagaaaagttactgtaaatatgtttgcattcgtcagactctatggagtctttttgaagttaaacattaaatctccactgtaa

SEQ ID NO: 49457 - DNA, 820 bp, Homo sapiens
cttccacttgtatcctatctctgttcaacaccagtgcaagtctttacaattgcataactgccttgggccaggcactatctatgttctgcctaccaggaataacagtgtccttgccactgtgacaacatgtagtctgactccaaaatcctatcttagctagcatctgctttcatgcaccacttctggtatcaactcttccagtttaggctcctcaggaagccgatatctaggtgggaattagcatgcaggaggtttattagggagcattgttggggtgggtaggaaagaaatcaaaattgagcagagggggaagttgggctgtgatatgtctaacaaaggccttaggaaaccaaccaggagatctaaacttggaatgaaccttctgacttgcccaagttggggtgaagaactgggcctttatagcccctacatcaaccagtcattgaatgtggacttttccccaggaaaggaaaggccatgaccttggctgaacaatctcttcgctgagacagctcatgaagaaggtgggcagcagagggctgtctgtcaacagagcccccagcagctagaggaattaatccttcagttttgaagagggacctgagaagtgcatcatgtcatccacgatggcctaaggtgccctttcctggtttatctaacaaacatctactcacatttcaagattcagctcagggccgggcgcggtggctcaagcctgtaattccagcctttgggaggctgaggggggtggaacatgaggtcaagagatcgagaccatcctggctaacacggtgaaaccccgtctctattaaaaatacaa

SEQ ID NO: 49458 - DNA, 460 bp, Homo sapiens
gagaaatatgaggaccagatatttataccagtttagttgcaaagagaccctgccttattcaccttgcattcccatttccatttgtcttaagatattttttaatttccttttgatttcttctctgacccattggttgttcgggaacatgttgttaaatgtctgcatatttgtagatttcctgaaattactcttgtgattaatttctagtttcataccctcatggtggggatcttctctttgcctcgtttgtggagtcttcagaccatttgctcacttgtaatagttcagctggctttaccacaaagtaaaactaccttttctatcttcccttgctacctcttgtgctaagctgctgccatactgttgtcctaatgaccacaccctccaggatgcagaggtggttttatcttttaggagccatcagggccgtggatgtggcatgccatccacctctgtgagt

SEQ ID NO: 49459 - DNA, 288 bp, Homo sapiens
acactttggtagactgatgtgagtggatcacctaaggtcagaagttcaagagcaccctggctaacatggtgaaaccccatctctactaaaaatacaaaagttagccggggggtggtggtgtgcacctttagttccagctacttgagaggctgaggcacaagagtcgcttaaacctgggaggtagaggttgccgtgaggcaaaatcgtgccactgccctcagcctgggcagtagagtcagtctccatctcaaagaaaccagcaaacaaaaaatattaaaaaaaaacatt

SEQ ID NO: 49460 - DNA, 275 bp, Homo sapiens
cactaatgaacttatgtaaccaaatacctcctgtaccccaataacttatggaaaaataaaataaaataataattttttaaaaagtattgcagagcagggtgctggaagcaggggcaaaaggcaggcagggccagatcagtcaggctttcaactgtggaaagcacattggattccttctaatgaaacgggaaaccactggagggattggagcaggggagtgacaggatctgatgtacaattgtgaaagacactctggagaatggattagcgggaga

SEQ ID NO: 49461 - DNA, 432 bp, Homo sapiens
ttccctacttttcatacattgagatctgtttaaatttctcacactcatgcagatcagaatatccaacattgtgttttttgtttgaaaagcacaagtcttcgttactttaattagctgcaggtatgatttgcattctgctgttctctgcaaaacttgtttcttctatggaaagagttaagactactatttgccagaggaagtccaaattccttaagttaacatttaagaccccttcagataattcctattctgctctttcaatcttaattgctttttcccacatgtattttatgttcttagaatctccattcctggctgggcacagtggctcatgcctgtaatcccagcactttgggaggccaaggcaggcgggtcgtttgagcccaggagttgcagaccagcctgggtaatgtgacaaaatcctgtctctac

SEQ ID NO: 49462 - DNA, 456 bp, Homo sapiens
aaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatgttgggctg

SEQ ID NO: 49463 - DNA, 336 bp, Homo sapiens
gctcaagacccactgaatcagcacctctgggagtgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatgttgggctg

SEQ ID NO: 49464 - DNA, 1114 bp, Homo sapiens
agatttcaccttgcaccctaggccacttgcccatgtccttgccatcttttaactcctgtctcaggagggggcagcagaaagtagtcttgagagttaatgggattgctactagtttgagtacctgcgggaggatttggtctccatcgagaaacaggggaagatgtcatctgcttaagaaggtatttatgtttgtttttctgcccggtgatatacatgaacccggtagtgtgtgaaataaagcatcttagtcctcatttcagtgaatcagaagaaactaaaaggcatggttatttctccctcggtatgatgaagtctatataatatttgcaaaatctcctttggtgaatttgtataaacaatctatcacaaagaaagtattgttttctatatgggcttaaaggatttttggaaaatgggcagaggattttcccatgtattccctgagcctggggaatggaaatcatctcatggagacagatgaccacaggctttccacccagtccccgtggcccactagaattgtccagcatgtttcagtggttatttgattgggctcaagaccaaagttggaactgaatcaaatgatggtttggttcagaatatttttccgttttggtacgttttgaaaacctaggtttgatgctggttgcagttgttcaacagattttttaaaaaaaactttgagtacaacacacactgaggccttttgcgggtggaggtagggaaagcatcaggataaatagctaatgcatgtgggacttaatacctaggtgatgggttataggtgcagcaaaccaccatggcacttgtttacctatgtaacaaaactgcacatcctgcatatttatcctagaacttcaaataaaataaaaacattttaaaaagaaaataaaaagagaagatttttagaaaaaaataaagaaaaagattttagagccacagaatctctttttagagtatgggaagaacagaaattctctgggtagagcaatttttgacagaagatgatttgggtttatatgagatatacaaaactattcttacgcatttttactgcatgccacaacttgggatttcttagtattttccacatcaaccacactactttaagtcg

SEQ ID NO: 49465 - DNA, 458 bp, Homo sapiens
atgacatttgaagaaaacggaagtgacccggctgctcaggagcaatattcatgatactgaaatcagagggaatttttttttaaagtttctggtttaagttggtgcccaggaggtgtggtcttttaactggtgtggtcggtgctctgtttgttactggtctgtgacaaggtaagtacagaaaatgagagtaaatttagaagcttttatagcaagttcctgagacatttacatctaatcatttttttttagtaactcaccttcagttgtattttacaaaagaaccagttcatgatggattagaaatttaaaatgaggatgctgacaataactagttctttactgcagacagtttgagaagcactggtttagaggatcctgtgtaaagtgattacgaatatcgtccatatagtaagttctatgttgtcttctcacttaacaggatgcactgttggctgatg

SEQ ID NO: 49466 - DNA, 146 bp, Homo sapiens
gtgacagagtgagatcctctttctcttaaaaaaaaaggggggatgaaatgagtgttaacaaatgcatagcacttggtacagtgccggcacataagaagtacactatacatgggcaacaatcttcctctttcaaaaagaatgtgttg

SEQ ID NO: 49467 - DNA, 2281 bp, Homo sapiens
  misc_feature (625)..(625): n is a, c, g, or t
ctgagaggtccactgtaagcctgatgggatttcctttgcaggtaacctgcgttttctttctggctgcctttaacattctttctttcatttttaccttggaaaatctgacaattatgtgtcttggggatgatcttcctgtgtagaatcttgcaggagttgtctgtatttcctgtatttgactgttgtcctctctagcaaggttgtggaagttttcatggacaatatattgaaatacgttttccaaactgtttgctttctcccccttcctttcagggatgacagtgatttgtagatttggcttctttacataatcccctacttcttggaggttttgttcattcctttttattcttttttctttatttttgtctgactgtcttatttcagaaagccagttttcgagttctgagattctttcctcagcttggtttattctactattaatacttgtgattgcattgtgaaattcttgtactgtgttattcagctatgtcggacccattaggttctttattatactggctattttgtctttcagctcctgtatcactttattgtgatttgtagtttctttggattgggttttgctgtcctcctgaatctcaatgatcttcattcctatacntatcctaaattctatttctgtcatttcagccagctcagcctggataaacactcttgttagagaatttgtatggtcatttggagcacatatgacactctggccgttttaatttttggagttcttgcgttagttctttctcatctccatgtgtgggtgttcctttaactgccatatagattgagtacagtcaatagatttctggctgttttcactaggctgaggccttgtgcagggtctttttttgaagctgacttcttgtctctagtttcagaggtgagtatgttagtgaggtattcttggtgttgaagctttggggtgtgatccagtaggtggcacttaggcttattggtcaactggtagactcttgctcagttgtgtggctcctctgtgttttctcatagttacagctgtgttcactctcaatgctctgaaagtgtgggttcctctcccccttcagtgccagctgtatggctatagattgtggtttgacactcctggctgcccactgcagctctggggcaatgtcagtgtttacgttccttcctcaacttggcggcaacagaggaaaggaccttagtagtggttgtggtcaagggtcttttgcttgtatcctgggagctccacaccagagagatgtaggtcagcaattcctcagtgcaatcaccccaggatgaagggtctgtgctgtgggctcaagccaggggttctctctggtgatgagtgggggttgggggtgtgggaaccatgggagacagactggcctcctcttcttgggttgattgcagcttgttggaggtataaataaggtacttagggtcttttcttcttcattagtctgagggtagcaagggcagttctactgcagagacagtggcagagaggctttcaggaacagtatttattaaccaattgtttcaacaaatatttattgacaattcaacatgtaccagacactgtgttaggcaaggggtcttcaatgggccacaaatagatgtggtccttgaccatgtcattggagcttaatgggagagactgatagtaagcaagtaaacaacaacaaaaaaataaggtaattcaggttgtgacaacctctctgaaggaaatatataggatgctataaaagtgactagagcaaggaacggcctaattgagctaagataatcaggtagggtctctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagatatgctgatatgtcccctggtattttttaaaatttttggccgggtacagtggctcatgcctgtaatcccagcactttgggaggccgaggtgggcggatcacgaggtcaggagtcaagaccagcctgactaacataatgaaaccccatctctactaaaaatacaaaaattagctgggtgtggtggcacgtgcctgtaatctcagctactcagaaggctgaggcaggagaatctcttgaacttgggaggcggaggttacagtgagttgcgatcgcgccactgcactccagcctgggtgacagagcaagactccatctc

SEQ ID NO: 49468 - DNA, 515 bp, Homo sapiens
gcatttcattcctctgctactttatgcattttgttcaattctttgttcaaaacgccaaagacctggacaactcgtagtcaatctgctgtgctaagtgctctgctagtctgtgtcatttactgtgcacacccatctcttgggtggatattaggaatgagcccatttctccaatgagccaagctaggccatggaggggttgagccatggtgcagtttctgcagtgaagaagcaacagggccagaataggcccacatggtcagactctcagacttacaaccttactcaagtacaatgagtgttccaatgatctgagcagaagaagttgtctttgtaagcagaaaatggctgaagaaagcaaaaagagaaaacagagcagattagtcattgatgtggtttggctgttttgtccctctaaatctcatgttgaaatgtgaccttcagcgttggaggtgggtttagtgggaggtgtttgggtcatagaggtggatctctcataaatggtttggtgctgtcaa

SEQ ID NO: 49469 - DNA, 1114 bp, Homo sapiens
  misc_feature (1112)..(1112): n is a, c, g, or t
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgagaacctgatggacggaatattacttgaccaacagactggttctggccggatcagtgggtctggacgatccgtagagttgcttcgggagcgcggcccttgaacgcgagacgacctgacgtgtggcagctgccaagaggggcgggcccagccctggagtcttacctgctgtgtggggctcatcntt

SEQ ID NO: 49470 - DNA, 2462 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49471 - DNA, 2317 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49472 - DNA, 2258 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49473 - DNA, 2251 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49474 - DNA, 2373 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49475 - DNA, 1886 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49476 - DNA, 2413 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49477 - DNA, 2582 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaaggtagcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49478 - DNA, 2582 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49479 - DNA, 1527 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgacctggtgaggcctcccccttcccaagtccattcccactgtaggccgatgcctgtgcaaaggacgcagtgccatatcagagaggatccttgaagaggactcaccccaagcaagggaaaattgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggaccaccaggttctcgagttcccattgctcgcaccggccacccctacacctcctgtgctcccgggctgccaccagctccggcaccaaccctgccagctgccggcactgccttgctgcgccctgactccccgcgggcctcctcccagcacgatgtggctactgctgcgagaccgaggcccc

SEQ ID NO: 49480 - DNA, 1212 bp, Homo sapiens
ctcaggtcagattgagtgcagattcccaacccaacaggccttctgttgcctgccccattctggtctttctgcctttggcttttgcttttcttagtggccctaaccatggtctcttcccagcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49481 - DNA, 1129 bp, Homo sapiens
tagtagagacggggtttcaccgtgttagccaggatggtcttgatgtcctgacctcgtgatctgcccgcctcggcctcccgaagtgctgggattatataaaggcatgagccaccgcacccggcccaattcatttctgttaagtctcagtttttcttctctgtggagggtaagtttctaactcttcttctctgggtctcccagacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49482 - DNA, 1384 bp, Homo sapiens
aagcacagttcctatccccaaggagcacactgttggctagacacccataaacagataaccacacctacaggtgctaagttttgggttccagggagagcttccgggaagaatttcttcctataagccagatttggtatggaagaagtcataccctagtcagtgggcacagcacaaaggcagagcagctgcaggaaccttagccgggagatatgcatagttgatgctggaaatttggagatcaggccaccagagcttggtgaatattggaacacctggctggtgccctggatttggttctgtttgtatcttacagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49483 - DNA, 1134 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgaagggcgcgaacatacctgaccaacaccggtaccgccggataaggtggcctgacctacccacaaaaatgccccgagagcccccgccacaattgaagcgcgacacaacccaacgtgaaacacaccacgggacggaggactcacccgtacccgcacacaccgaccgctgtgatgctcctctatattggcagcacgccctacagag

SEQ ID NO: 49484 - DNA, 2368 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49485 - DNA, 2246 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49486 - DNA, 2462 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49487 - DNA, 2286 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccacggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49488 - DNA, 2254 bp, Homo sapiens
cgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcagactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49489 - DNA, 1773 bp, Homo sapiens
tatttcagtgcgcgggccgggctgtgttgtacatgactgggcgtgggccgacagtttgcacttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49490 - DNA, 1290 bp, Homo sapiens
aagcacagttcctatccccaaggagcacactgttggctagacacccataaacagataaccacacctacaggtgctaagttttgggttccagggagagcttccgggaagaatttcttcctataagccagatttggtatggaagaagtcataccctagtcagtgggcacagcacaaaggcagagcagctgcaggaaccttagccgggagatatgcatagttgatgctggaaatttggagatcaggccaccagagcttggtgaatattggaacacctggctggtgccctggatttggttctgtttgtatcttacagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49491 - DNA, 1223 bp, Homo sapiens
tagtagagacggggtttcaccgtgttagccaggatggtcttgatgtcctgacctcgtgatctgcccgcctcggcctcccgaagtgctgggattatataaaggcatgagccaccgcacccggcccaattcatttctgttaagtctcagtttttcttctctgtggagggtaagtttctaactcttcttctctgggtctcccagacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctacccaaaaaacca

SEQ ID NO: 49492 - DNA, 168 bp, Homo sapiens
aggacaacagatccctctgtgccttggaacccagtggctgtacttcactacccagcaaagcctccacggttaggactgggcgaccctcctccacagatctctccaaatgcatctcacatctggcctcaaattttcactccatccaccctgtgccggtctctgggaaca

SEQ ID NO: 49493 - DNA, 204 bp, Homo sapiens
aggaagaaataaaatactatttgtaactctgaaagttatggtttaatttttttaaatactgcaactagttttgatatgccagaaaactcagtaatgaggtatcatatatacccacagctaaaccattaactcaaactcaattgctatatattttaaatttaagattttactatacatatatttatcactgacaaatacataagt

SEQ ID NO: 49494 - DNA, 233 bp, Homo sapiens
ttgcactccatcctgggccatagagcgagactctgtctcaaaaagaaagtctttagacaaacgcaaacaagttacttttgattggttgaagaaaataatgtgaccagaggctggcaggaatctaaccctgtatttcctctaaccatggattccatatttacttatttagtgtttgccacaactttgtagagagcttaactactgtgaataatgagaaatgactgtattttaat

SEQ ID NO: 49495 - DNA, 2204 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatatacaggtgggagccacaacacccggccatgaattaactccgttaaaaaataaacgtatacattctgtgagcaaatccat

SEQ ID NO: 49496 - DNA, 2881 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggatgggcttaaggcctacacagaggtaaagacggtcaccatcaaggttcctcagaagaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccatcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccat

SEQ ID NO: 49497 - DNA, 1594 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccagcaattccacaaccaccttgaccaatgcttgccaagctgttttaaagccaagaacaccctttctttgttccaaattaactcttagaagaaaccccacaaataaagcaattcaatcaag

SEQ ID NO: 49498 - DNA, 1584 bp, Homo sapiens
gcacgaggtcttgggctgtcagcctgtcaagtcagagatagagtggtgagaggcacacacagtatgctgctcgctggtcaccggattgacagccagtcttaccagcatcagcgggcgtgtgggtacctacacatgtactcccagcattgaggttagaattgacggagagtgggtagatgctaagctccaaggaagggtccacaggtctcaaaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccatcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccat

SEQ ID NO: 49499 - DNA, 3073 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccatcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccat

SEQ ID NO: 49500 - DNA, 1860 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaag

SEQ ID NO: 49501 - DNA, 2807 bp, Homo sapiens
gcaggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcgggccgtgaaagcagcccgggaagccttccgcctggggtccccatggcgccggatggatgcctctgagcggggccggctgctgaacctcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacatggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccatcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccat

SEQ ID NO: 49502 - DNA, 1832 bp, Homo sapiens
catagctgttcctgatgtacacttgtatccgcactaccgtagcgaccgtagtagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgaccaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccatcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaatccat

SEQ ID NO: 49503 - DNA, 395 bp, Homo sapiens
atcatgagaacagcagtatgggggtaaccatcttcatgattcagttacttcccatggggtctcttcacaacatgtggggattatggaaactgcaattcaagatggcattagcaaaccagattgctaagtaatcaccgtttttcaccaggtgacaatttctaccaaaaacctataataaaacattaagctaaaaagaaaagtgaactcatcatttcacaagctatgccttaaaagtcttacaaaatgtttacttgcttgtgtattagagtcagagactatttatggcagagattttgtatattagcaaaagaaaaataaaattattaacatgctttttagagtaagaaatgtatgacttgcagtttaatgcaatgttaataaatatgacactgctc

SEQ ID NO: 49504 - DNA, 514 bp, Homo sapiens
ttatgagaccactgttgtatatgatgtctgtcattgtctgaacgtcacatggcacataacagtagtttataatttccctgaataaactgcctttggaccaatttttgatcacttgtctcttgattagtcacaggcatgatcacagtcctattactcttgcatatctaggcacatggctctcatgcatactctagatccagaacacattaattgggggtaatactataaacatgttggagaaattatgggtatgatgcgtttggttatacttatacccataatctcactcatgcatgctctacctctatccaaatacaatagaatatcccaaatgagatattatctctcttattttgataactgagtcatatatgaaggtttttaactcagttataaatctataaatcaaattactttgtctatttatagaaactagtatgtttgcacattgacaggtgggttgaacccaaggaatgatgaatcctgaatttgtattcagtatgctaaaaaaaaa

SEQ ID NO: 49505 - DNA, 418 bp, Homo sapiens
tggggtatttgtattttaacttaattttgtaaggtttttatgttatggaaatatattgatctttatatgttttaggctttaatgtgtgtatgagcttcctaggttgccagagcaaattaccacaggcatgcctaaaacaacagaaatttatttcctcacagttatggaggccaaaagtctgaaatcaaggtgttagcagggtgattctccctcctaaggctcttagaggagaatccttcctggttctcccggcttctgctggctcctggtgttccttggcttgtagcagcagcactcacatctctctctgtgtgttcacgtggccttgtcctctgtgtctttgtctaaaattttcttctcttgtctgtgatacagacattggtcattgtgattagggtccctaaatccaggatggtct

SEQ ID NO: 49506 - DNA, 383 bp, Homo sapiens
  misc_feature (378)..(378): n is a, c, g, or t
ctcattgtccaaatgagtcactgaggctgagggattcaggctcagtgtatgcccacagttctttggcaaaccccaccactgggccagccaactacacggggattctgatcgggtcctgatgggtgcccatgatgggctgtgcaaaagtggtggtgagatttctccaccttcacggaggtggtacccaggggaggtggacttcagcagcgagaatgggctgggtgcagtggctcacagctgtaatcccagtgctttgggagttcgaggcaggagaattgcatgagctcagttgttcgagaccatgggagaccctgtctcgaattccaccacactggcggccgcaaggagaggacagcgattctcgtacgaacggttacngatcg

SEQ ID NO: 49507 - DNA, 607 bp, Homo sapiens
tctctcttgcaataaaaccgtccctccttttattcttatgggaggatcaaaggagtgaagagaaggctgaacctttttactgtctctatactcattcttatactttttgttttcattttcaaaacctttatttctattatccaaaattactttatcacttctgatctagaattaatttttatcttcttcccttgtaactaactcctctattttctcttattctcctctaacattttcattgtttttttcccccctatggttcttttcttacggctttgaaatgtacaggtaccagaataggtcttgggagagggatgggatagaacaagtgagtttgaagttgcaggtaggggcaacagtggttgggctcaggttcaatgatccttgctctcaagagaggcaaaaagcactatgccagagtctccgtggtggtctaaagggtgcctgagttttgtacttgttagagaaattaagtttactataaccaaaaaggtttaatgtttagaagttaaaagcaagtgaagaatgtctcattctgaaatagaccaaactcaaaagcctaagaatgcagggtgggaatgagcagaagttaggattccaaacaggt

SEQ ID NO: 49508 - DNA, 801 bp, Homo sapiens
taatcttttcgtatttttagtagagatggggttttgccatcttagccaggatggtctcgatctcctgacctcgtgatccgcctgtctcggcctcccaaagtgctgggattacaggttgtgagccactgcgcctggcctccagattgtatttgtcacagacattagaacgttggtcctttgcttaagtgcttccactatgcagcagtaaatatacagagtacaaatagctgagtaaagaagtcggtaataagtaattttcgttaccacataattgaaaaaagaacatactccattgatgatgaatgaacaatttgcctctgggtcactatccatagggaagttacctgttacttagtgtggtagattaagacccataaaggggaccgagttgcttttcacatgggtaagtgtggcaggtgccctattagatgatggcctcagaagcatgcttgttaaaattctaattgatattaactgggtcagtagattgggaatgtttggcacatactctctgcttttttaacttgatgtcatgaaggactacagttattttgcacagaatgttttccattgtcacagctatttagtatttattgagcagccaatatgttattgggtactatatatatgtatgtatacacacacacacacatatgtatatacacacacacagacataggacatttatatgtgtgtgtgtgtgtgtgtgtatatatatatataaaggatatgtgtatatatctcatttaatccttaccataaccctgtgagcagatgacactgctcctattttatatctga

SEQ ID NO: 49509 - DNA, 546 bp, Homo sapiens
tgtatgtttccagagagattttatgtgttattgatttctatttgggtaaaaagcgggtcattgcattccgttgttctctagaaagtccatactcagtcctatatccatagcaattgggctggtgtgttttttttcttcttcttcttttacatttacatttttatagtctctcataaaatggcttttttttttttttgagacaatctctctgttatctaggctggagtgcagtggcatgatcatagctcactgcagcctccaattcctggcctcaagcaatccttctacctcagcctcatgagtagttgggataacaggcatgagccagcttggctgcatgtttttgaaaataggtacccactcttaaatctgtttttcaggctcagtagtagtggtttaacttttaagatttccagtaattagataaattacttgaagcactcctagtattttttcgtatttcagacattaactctcccagctgtttatttttttactttcgtgttttaataaccctctatgactttaatttcaagaactgaagca

SEQ ID NO: 49510 - DNA, 708 bp, Homo sapiens
ctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggtgtagtggtgggtgcctgtagtcccagctactcgggagactaaggcaggagaatggcatgaacctgggaggcggagcttgcagggggcgagatcgtgccactgcactccagcctgggcaacagagcgagactctgtct

SEQ ID NO: 49511 - DNA, 303 bp, Homo sapiens
ccaagattagtgcttctactcttaccccttaccctcatagtctattctcaacacaacagctagaatgatccctttagagatataaatctgatcaagtagctcttgtgttcagaactctccagggctttcagtggtgaccggcaaaattgttgccataattgagaaggccctgcatggtaaggccccagctaccttttttatctggtctcttagcactctccccatcactcactctgaatcaacatagtgatctccttgctattcccatagcacctcaagcaggctcctgcctcagggcatttg

SEQ ID NO: 49512 - DNA, 480 bp, Homo sapiens
ggcgcatgcggctatttttaaccatctgcactgcagaatcatcatcaaagctgtagccaaggatttataaaatgggcaaggcaaccctccctctgagctgggaggtgtggggctaagggttatgaggaaaatccagtggaccaaatattgtattcatccagcctccctcaaccctctttcaggtggacagttccaagctccagagcatcctagaaggtagcccagaaagctgcatttagggctgatgaccccactactacccgtgttggcctatctggtcattgaaccaagggctttggcaaatctggttgaagaagtggcctcttgtgcctttaaagaggcttatctagctacatcctaccaccctggttatgttctcttggctcttgctggctgacacaaaaagaagttatggccaaaagtgggggttcacttaaagttccctctttaatattgttatattctataggaattttgtta

SEQ ID NO: 49513 - DNA, 475 bp, Homo sapiens
tatcattttaacatcatagaagaacatttaagacatgtttgtaagttgtaaataatgactccagttatagcatatatatctaagacgttagagaccagttattttctagagtgaaactgtctattgatgattgagaaaattgaattctttggtttttacatgtgggcaaatgttacataggggtataatctgtttaaataagctttatttatgccaaggattttttttttaatatcaagacttggttagaccaaagtttgctcttgcaggaatgccatttatcagcttctgaatgcccttctaactccattaccctcaagagtgtctgggtataggatgaagcattacaaaaagaaagcaccactgcagtcatgcctagtgtctgggagaaacaaaatggactagacctgcagtttaaaataatttaacccgagaaactcttcaaatgaattgtttcctaaagatgctcaaattt

SEQ ID NO: 49514 - DNA, 199 bp, Homo sapiens
  misc_feature (140)..(140): n is a, c, g, or t
  misc_feature (142)..(142): n is a, c, g, or t
cacatgtattacatcacccagttttcatggcaacctgtaacacaggtattagtttcattttatagataaactgtggctcacagaagttgaggacgttttataattcactgaacaagtacctcttggcctttggccatgtnanactctttagataatgagattcagaaaagagaattcacttaaaaaatgttaagaaaac

SEQ ID NO: 49515 - DNA, 808 bp, Homo sapiens
cattctgtgtgtaacttctgtacctcatctgcagagcctggctagccatctcccctcccttaccgtcttctgtatactgactgcctttcagagttattattcattatctctgtacctgggaaataacttttaaggaaaaaaataaaataaaaacgctattttgaaaaaaaaaagccgccttctttctgatggattgtaggtccatgcaggtttttggttacagctccctgagatagatgtaaatcctaagcattgtgggtgttttggtttgatgggactggattgaaagatttacagacttaaattgtaaaggaaggtaatttagagagaggaaggaaataaacattatgttggtttggttataaccactggcttgtctccactgacatggcctgggggtgagtggtgtatttgcaaagctcctttcaggtctgcattaatctctggcattagttggctgtgaccgattagcctcccagttaaagtatgtagtcagttcttagtgatggtaaatgggttactgaggccttcttattacatccaattatgaggtgactatataatttatcttgcaaactgttgagtgtgttctaaacagtatgctgtgggggcgctatcactaattatgctggacctgttagagtatgatccccctatccaagcagaaaaatgtgaatccccaaactctttccctgcttacgcaaagcaatgaatggtcatttcttagggtcaccagccctttgagaatctgataatagttgtggattgccagccatgcgtggattgcgagccatgcgtggattgccag

SEQ ID NO: 49516 - DNA, 540 bp, Homo sapiens
aaaagcaattcatgtacccttgaagattagattaagttctataaaatagcccaaaatgacagtggctgaaacaagtttatttctctcccatttaaagcaagtctagatgtggaagtctgggaagcccagaaaatccaggtcttgtttgtgtatggaaactccagaaaatcacagattccttccagccacccctcaattacccctgggatccaagagagccactaaagttccagccatcatactcacaacccaagttgtaggatggaaaaaaggacacaaaagtagggtgaagagcatgtgtgcaacagctctcttttactctagtgtcctaaaacctatcataaaacctttggcttgccttgcattagccagaatttagtacatggccacacttaagaagtcagaaagattagctttttttccagggtagttggctgaaaatcaggagttctcatattaaaaaacagagaagggacatcgaatagatgaccaacaatctccttcacactcatactatttaaactgtcctagtcaatgacc

SEQ ID NO: 49517 - DNA, 318 bp, Homo sapiens
tcagcctcccgaactgggattacaggtgtgtaccaccatgcctggctaattttttatatttttagtagagagagggtttcaccatgttggccaggctggtctcgagctcctgaccttaggtgatctgcctgcctcagcctctcaaagtgctgggactacaggcataagccactgcgcctggccaaaaatatgaatacatttggctatttccaccctttctgttaatcccaaggatcttcaacttttattcttctctttaagatagtgagtcctggaaataaaagtgaaaatgaacagttctaaaaggttagtatttta

SEQ ID NO: 49518 - DNA, 282 bp, Homo sapiens
caggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaact

SEQ ID NO: 49519 - DNA, 562 bp, Homo sapiens
aattatgataactagagattgaagtggaataactgtaatgttctttgagaactttaaacttacttcttttcatgtctttcaaatacttccctagtggtagatattttggacctagatcaattgggagtagagaaaaggagatggaaggaaggaaaggaaataacttttattgaatgtctgttctgcagcaggcactgagtaaggtttgtcatagtcatatattgtagcttgctgtcgctttcatagcagtattatgaattagtaatgcactctctatttgaacggatgaggatagactcttcagagtggccaggttacatgtccagagcaagattcaaacccaggtcttctgatttcaaatcttatgctcttaaacaattcaaattcattttgtatccttctttatatcttattgtttagggttggatgtcgttttcatggtatcacacacctgccttgaatcaaagggaaagtaaaaagtcaaaatccaaacccctcccattggagatatttcactgtcaaattcagatgttagccacagaatgaggccacacttgataaa

SEQ ID NO: 49520 - DNA, 3589 bp, Homo sapiens
aaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaacttacagttaatcgttgcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttgggagtggggaagggtataaaggaggcttaaaatttgaatccataatatatctaattacgggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgttta

SEQ ID NO: 49521 - DNA, 3394 bp, Homo sapiens
aaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaacttacagttaatcgttgcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttgggagtggggaagggtataaaggaggcttaaaatttgaatccataatatatctaattacgggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgttta

SEQ ID NO: 49522 - DNA, 3787 bp, Homo sapiens
  misc_feature (3407)..(3407): n is a, c, g, or t
  misc_feature (3461)..(3462): n is a, c, g, or t
  misc_feature (3492)..(3493): n is a, c, g, or t
aaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaacttacagttaatcgttgcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttgggagtggggaagggtataaaggaggcttaaaatttgaatccataatatatctaattacgggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttaaaaaaaaaaaaanaaaaaaaaaaaaaaaaaaaaaaaaaaaaaaaaaaaaaaaaaaaaaaaaaaaaannttttaaaaaaaaaaaaaaaaaaaaaaaaanncctttgttggcccctttggcccaattaatttttaacttgaaaaagttttttttttgggcccaaatttgggtttatttggccaattcccccttatgggaggggtttaaaattacagggccgggttttaaaaaatgtaaattggaaaaccctggggtccccatttaatagcctttggaaatatcccttttgcaggtgggaatataaaaaaagccccccacatacccttccaaaattgtgcaccctgatgggaaaggaaattgaaccttaaattttggaaaacccgtaaatttttaa

SEQ ID NO: 49523 - DNA, 3625 bp, Homo sapiens
cgcgcagtgcgcccgggcaaaggcggggatctaggcgccgggacaagtccgcgcacggccctgcccacgtcctctctccttggcttcgtccccagcttccggaactgctgcggggagttgcgaactctggtcctcttggcagtatcggcggtgcgcctgcctgcctgctgtgactccagggactctaaaaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaacttacagttaatcgttgcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttgggagtggggaagggtataaaggaggcttaaaatttgaatccataatatatctaattacgggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgttta

SEQ ID NO: 49524 - DNA, 279 bp, Homo sapiens
ctgctaaggaactattattcctgtgtggggaaagagagagattgcttgattgattgaggggaatcttagcaacaacagattgattgtcctcttcacagataacttcctaatacacattccataaattacagttttactaggaaagacatagggcattatattcctctttgcaaatacttttttatagaaataagccttagtataactttctttattagataattgaactcactttcttgagggaatgaaagaaaaagcatttatttcatgatgaggggc

SEQ ID NO: 49525 - DNA, 323 bp, Homo sapiens
cttccttgtgtacatcttgtttccaaaagaagtagccagctcttcgtggacaggaactgtgtcttacttttttgccatccctcacctcaggcagcactgccaagagcattcacagtgactgtggaactccgttgattgaatgttggcttgagtaagttcctgatgtaggggctgtagcggttggaatcaagcttctgcaatactcaagtagtcctactgaattacagtactgtcagaccccctctgcacaaccctgaagtgggtcagaactccacactgtgccataaagaggaaagctgtcaacagggaggtctaaggaaaca

SEQ ID NO: 49526 - DNA, 548 bp, Homo sapiens
ccattatttccaatcaacagagaaaaagatggaggcctagacaggttgaataagttgtctaaggtaagtgctaagtggtttggctagtaggtaacaattgaatgttacactgaaatgtacaatccatatgtgctgtagaaattctgagaaacagaaaacgatttggatttggattaagtggtcagagctgtcatagaaaagttatggcttgaactgagtatcattaaggtaaaggatttaaggtttgataaaataaatcagaactgtaggatggaagagccattatgagcccagcaatgaaactggagtgatcatggcctctatgtggccagtatcccagggtgcttggcagaatagtgggagagaaggctggagaggaggcttagccaaagaaaagaagtttgatgaaactgctttttctcacaagaccttatgggatttacttcacctagctttttgtctccagctacttctgcctccttccacatgacgcatacattagctacgctcaattgatatttattgaatgcctactgtgtacaaagtac

SEQ ID NO: 49527 - DNA, 369 bp, Homo sapiens
agagtcatatggtaagtgttttttaatttttcaagaaacttccaaactgctttccaaggtaatcgtaacattttacatgcccaccagtaatttatgagcatttcagctgttctacatcctcactgtcttagtttgttttgtgttgctataatagaaatctaagactgggtgattaataaagaaaagaagtttatttcttacagttctggaggctgggaagtccagggtggagggaacatatctggtagggacttcttgctggtagagactctctgcaaaatcctaggtggcacagggcatcacatggcaagggaggctcctgagagagccaaacaggctttcataacagatccactctcatgataaata

SEQ ID NO: 49528 - DNA, 861 bp, Homo sapiens
tatctctcaatcatgaaggtcaggaatttgggcaagtcttggcaattcttctcttaaatgtagcatcatcagctaatggtattcagctaataggtgggcaggactggaggattctaagcagctttatttacacgtccggtgatttggctaggaaggctggaaggctaagctcagttgggcctatgtctgcgccatggtctttccagcatgacggttttagggtagttggaatctgagcagaagctataaagctttttatgacgttctaagatccaagccttgttctgtagtcaaacaagtcttactaaggtcacctgaatttaatgtagaggaatttggaggaataaccaagaataactaataccacacaaggttattagagtttttttttctgttcctgattgttgcttttaggagaatgtcattagttcttggcttcttagggaatcttttccttatccctcccatctgaaggggattccctgtagtagagggatatcatgtacttctttttcagttcacttttataataatatttttccccatgacagtggttcccaactgggggaatcactctccaggggcatttggcagtgtctggagacatttttggttgtcacaacaggtggaaaggggtactgttcgtgtctagtggatagaggccaaggatgctgctaaatatcccacaatgcacaggacagtgcctgcaagaaagtactatctgggctgggtgcagtggctcattcctgtaattccagtaatcccagcactttgggaagccaaagcaagaggagcacttgagtccaggagttcgagactagcctgggaaacatatagaccctgcctttacaaaaaaaaaaa

SEQ ID NO: 49529 - DNA, 380 bp, Homo sapiens
agtttcttatatgctattagggtcagatgcatgcatgcacaggttgggggtgagcccaggagtccataaacaactttatagggttactttcccaaactccttttctgtgctctccatgatacttcctggttccctaggactcacctttccaaaccttcgaacagaaaccacccaattctgcggctgtgccatgaatgacaaggtggcaagaggacagagaaaaaaaatgtgacaggttttggttttgtgctcctagagtcctggcttcctcaaataaagaatggttctctgctctcactgttttggctcctgcatgttcctgttacctgctgctcctgttacctccagaactgtcggcgtgctggtgcaagagaaggggg

SEQ ID NO: 49530 - DNA, 512 bp, Homo sapiens
gataattttgatgtttcatggacatttctaataagagcataaggagcctgcatcttcctgttacccacagtggggaactaatgcttcagcctggtggagttctcgctggatcgtgtaggagccacagacttagccagactgcctaacttcatatcttggctttgcgagggcaagttgctccacttctttgagtcactttttatctctttcaaaatggagacgataataatggtttctttaaagggttgttaaatgattaaatgattaatatatgtaaagtgctcagaacagtgtacataataagcactatagaagtgtaggctgttgttactgcacagtacttgaataagctacaaatgtcacttttaaattatctagttcttcaggaatataacatcatgaagaatatatggacttcgaagcagaagttgtgaatttcttattttaacctaagttgtatttctttttccaaccttatttctttcccccttttaaatcagtttcaattgttt

SEQ ID NO: 49531 - DNA, 1739 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggtaagattattctttaaacagtcttatcaatctgtgggacatagactctaaatagaaaggaaacctgcggctccatgataaaggagcccatagtctgtggtttgacatttaccttttctgagagtagtcacataagtttttgaaacaacacttctgttaacaatctaggagctgcaccccctctgggcacctctgcacaggctgaggtgacaccctattaaagtgatcagctggaagacagaagaacagaatttagatgaaaaatatgctggtgctcacatgtggatgccccatttatcaccctgctatttaaaagcatcctttaatagtctgtacatttttttgagtcaggcaggggttgcctggttatttttcctgtaaacttaattggaatcagaagcacttgacaaagaggtaatgttcaggatctggaactgttatttctctattgtttcacatgttattttccctgtcaccctctgtgagcccgtccttttcatcaccgttgtgtctagtgtgggttccctccctgaaccagtttcgtgcccagattgacttaggttgggctgttccaccacatcagtgttttcccaaatattcagacatataatcaggatgtcgtcatcaacccatattttttcttcactcatattttttcaggggagttacctaataatttatagttctcaaaaagctgatactacactgggcaaaacaccaagacaaattaggccagatggtatgaattttactgtaaaaaaaaa

SEQ ID NO: 49532 - DNA, 1417 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccggtcctgaagcaaatggttcaaggtaccatcccctaaaacatgagctctccaaggactgccaagactgttgtgctacctggaagcattagaacacattgtacaattggcacaaatgcaagagagaagaaaattcacatgctaacccctgagggctagaaacaggagggagtgcagcagctcctgctaaagtgtgtgtcagaaaactcagactttttgtgtctgccacttttatcctgagtatctttcatgagactaagcctttcattttgataggtaatgaatttttacaagttgaagaaatcaagctaatacatttgcagggataatttggttaattaccatgttgctgctggtagaatcaagggctggaagtcaaaactgtttccactgctaatatgctctgtgtaaagcagttcttggaacaattaaaacacatctatcca

SEQ ID NO: 49533 - DNA, 693 bp, Homo sapiens
agcgtagagattacgtgtgttattaaaaggattataggactcagtgcatggtgactaacacctgtaatcccagtaactcaggaggctgaggcgggaggatcacttgaggccagaagttcaagaccattctgggcaacacagcaagactccatctcaaaaaattaaaaaaaaattttttaagtgaataaatggatgaagaataatgaatgaatgattttgacctcttgctcttcacccttttgtccttctagtcctgaagcaaatggttcaaggtaccatcccctaaaacatgagctctccaaggactgccaagactgttgtgctacctggaagcattagaacacattgtacaattggcacaaatgcaagagagaagaaaattcacatgctaacccctgagggctagaaacaggagggagtgcagcagctcctgctaaagtgtgtgtcagaaaactcagactttttgtgtctgccacttttatcctgagtatctttcatgagactaagcctttcattttgataggtaatgaatttttacaagttgaagaaatcaagctaatacatttgcagggataatttggttaattaccatgttgctgctggtagaatcaagggctggaagtcaaaactgtttccactgctaatatgctctgtgtaaagcagttcttggaacaattaaaacacatctatcca

SEQ ID NO: 49534 - DNA, 4044 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaactccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttcta

SEQ ID NO: 49535 - DNA, 2564 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacaggattttggcaaagccctcgtg

SEQ ID NO: 49536 - DNA, 788 bp, Homo sapiens
ttatatgcacgtatagaaagatttcctatgtagaaacaaggtattgttattgagtaccttagaacaacaacaaaaatgtttaagtcttgtttgcgcacgacgcactcagccgcttctgggcctgtttctcttttcgcctgcagttaccgatgcctggccctcctgtactggcggatgtttcgactcaaaagggaccacgctgtaaagtattcaaaagcactaatcgactatttcaaggtactgtctagtgaatgagcagaattgttccttaatttcacttgtctccctgtcaaatttgtgaagcacctggtagactccattgctttggggttaatgcaggtcacctctggtccccaaggtaaccccatttatgccacacttgtggctttcaggcctcagaatggacctttgagagcccatctaatgtatctccctgccttcttgtccaagtatttttatttttttatttttatttttttatgtatttttggagacagagtttcactctttgttgcccaggctgcagtgcaatggtgcgatctcggctcactgcaacctccgcctcctgggttcaagcaattctcctgcctcagcctcccaagtagctcagattacaggcgcacaccaccacgcctggctaattttgtatttttagtagagatggggtttcaccatgttggtcatgctggtctcgaactcctgacctcaggtgatctccccgcctccacctcccagagtgctaggaatacaggtgtgagccaccacgcccagccttgtccaggtatttt

SEQ ID NO: 49537 - DNA, 4092 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatttctcccaacccctttcccggcagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttcta

SEQ ID NO: 49538 - DNA, 1445 bp, Homo sapiens
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagccttagctggtagctgcttccttctgaaatgccctcctctgtctcagctccactgaccattgaaaccctgtgttctctgctacgtcacttcttctacaagacgtgccttgcttccccttcaccttccgccatgattgtaagtgtcctgaggcctccccagccatgtggaactgtgagtcaattaaatttgtttctttataaattact

SEQ ID NO: 49539 - DNA, 2678 bp, Homo sapiens
  misc_feature (2658)..(2658): n is a, c, g, or t
ggccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagaaccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaaaagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcatcgatnacccggggatccttagatca

SEQ ID NO: 49540 - DNA, 518 bp, Homo sapiens
ttttaagtgagcctgtaatgaaagatgttttgtttgtcaccggttttctgctttcaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgc

SEQ ID NO: 49541 - DNA, 679 bp, Homo sapiens
ccaggagctaccagttactgtctgcacaatcaaacagaaatagacctgtccttgatggttaacggaaataaaaggcgcttgtcccagaagctcaggtgaggcaccaccctgattatgggaatcacctgggaacatatacccagacctaaaactcagatccacttcccaggctgtggttatatagtcaggggggtgcagtatgggtattaggattttttattttttagttataaagatttttttttggtttgtttttgagacagggtcttgctctgccgcttaggctggagtgcagtggtgcaatcatagctcactgaagcctcagactcctgggttcaagcagtcctcccacctcagcctcctaaggagctggggacccacaggcatgcagcaccacacctggctaatttttaaaaattttggtggagtgttgcccaggctggtctcacactccctggcctcaggcgatcctcccaccccagcctcccaatgtgttgggattacaggcatgagccattgtacccagccactaagatgattcttatttggaaacacggtcaagaacaactgcgttcggtagtttaaccttttttgattgtggtggttttagtatgccttaccactctaccatagtaagaaatttgcagaccatgtacaccaacctttggtgctcctgggg

SEQ ID NO: 49542 - DNA, 274 bp, Homo sapiens
ggctaagagtgagggaggcaagtctccttacttttgggggaagcgggagatgctcaatgggaatagaacccacaaatggaataggtatacttttctcaggatagaggcaacgatctgtgcttgagaaagccaggggcagagctgtgtgatctgtgtctctcagctgcctgtagaaggtgatgggggagagagtgggcgcattggcaggggggggtcccctggagataggcctccctcactcttagcccgagggacaactgggaatatgattgcc

SEQ ID NO: 49543 - DNA, 500 bp, Homo sapiens
ttttttccaaataaggatggccacatccacaggttctgggatgtttacatattttttgtggtgggagccaccattcaactcactacaaaggccttggaaatacatcctaagagcttaacttctaggcgtcatagcatgttaagtccacgtaccaggtgaacacatcacctcatttgtctgtctgaccaaggttcacgggaatgactcattcgaggcatttcaggacaactaaagggatagaggacctggccgggtgagtggcagaggtggggaacctgttgtagtacacccctgctgtggggggtggagggagagatggccaggctggcatcatcatgtagttcccacgggcttaggagtctcagctgggttcaaatcctggctcttgggtgaccttgggcaagtacccaaccctttttggcctcagtctcctcatttgtgtaatgggcatgaggataatggcatctgccttatagtgttgctgtgagaatgaaatgata

SEQ ID NO: 49544 - DNA, 704 bp, Homo sapiens
acttgagtccaggagttcaaaggtgcagtgagctcggatcacaccactgcactccagcctgggtgacagagcgagaccgtgtatgataaaacaaaaacagaaaacatccagaggtttgtatagaagtagttatcttgcaggtgttcagaaggacctgactgccaaaataaggcaggccctcattatttcaggtgcagtcatttaagtttcttattggctatggttttttgaagaaataatttttatagatttataggatggtgttcacaaagactactgtatttgaatttttctatatattttcaattctcatacatccgtattagaaattatgtattgtatttatggtcagatttattggagactgctgcaaaaaacaaattactggtatggtgcactcaaccaatctcaaaacgaatccaagggcaccagaatataagttgcacaaaggcagaaatctttgtcttttttttttttctcatgtgtgctaaacacctggaagggtacctgcatttaatgggtgcaccataaataatgaatgaaggcaggcaggtaggcagacaggtggtacaatcaggatccccttaatatgaattgggggtagtttatgtaaaatttttcctttttacctactttctgatcattatatgaagtagattgggatcagacttaccaatattagctgtggccgggcgcagtggctc

SEQ ID NO: 49545 - DNA, 782 bp, Homo sapiens
ttaaaatgtgtgacactttcttagttcctactttgtgcttccttctgttaaaaatcacaagtagaaagcaagagagagaagagacaaaaaagaaagaggtagaaagatatcaagggaattttcctgctagtgttatactttattttcactgagaatagtgagtcattaaaatgtatagtaagagagatactgtttctgatatactttgttaaaacctgtctctcttgatctgtgtaaaaatgtgttttccatatgtatgttaaagtgtatatacatacataagttcacacagtttagctgtttttgttttcaaatgaaagctgaaatatgaagatcagaactttattaaattcccttaattttattgtaatattgttttgtagatgagagatttttatttttgaaaagttttaaaaataaatagcaaaaatgtatacacccacatacccacatataaaatgttaacatatttcatttttgcttcagatatatatttaatttaaaataactatttatatcatagttatcacattgaattctaaaagagcaatgtagaactttatacttttcttgaatattacagatcatgttaaagtcccttttgttctccccagttttatcctcctcaccttcatctcccctcccagaggaaattgttgtaatgaatttgatttgtatccttctagtttatcttttaataaactatatatatgagcaatgacatggcattgctttgggtgcttttgtagaacatgcacattgtagtacatttcaaatcatac

SEQ ID NO: 49546 - DNA, 497 bp, Homo sapiens
ccgggacccagggcacctgcagcggggctggtgcgagtgttgtcccgggaaatgccggaatgagacgagacgatgaaaaccttaagtgtggaactgcgtctcaggccagtgttctggctgaaagagtcacccctagtcacccctcgtgccctaggtcggccccgctgtccccaggggcaggggctgccgtatgctgggtcagcttaaagcgatgctccacaaacttggacaactttctagtcgttctcacatcagtactttgggaaaatacaataagggtgaaatactagaaaaatgttcacgtgcttcgatgccatgtaatggtaaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactga

SEQ ID NO: 49547 - DNA, 707 bp, Homo sapiens
taagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatggggatcgttttcgattcgcactaaactccatggtagaaaaacacctgaattcacagatgtggaagcacagaaacccgagccacagggcatcaggtccctcccccctgttcaggacttgcctaaccaatctgctgtcactgagcaacattggggctgcctgggtgtcaactctggagagcgtagcaccccgctaccctctcaacctcgctgcccaaaccccaggccccggcgggcccgaacctggagggatggcagccgatgggggcgtggaagacattaggaagaaaaggaacggccaagactcttttttctttaacaagcatttaactctgcatcagggagccgccaacacagtattctctttcagccagggaagatccctcctgcggcagatagccccctgcctcgccaggagccacatcaacaccccggtccagcatccgtttgcagccttagcaaccagggtgtgttttcc

SEQ ID NO: 49548 - DNA, 370 bp, Homo sapiens
tgtgtttctattttgttttaatgaaatttttttccttttgttgatgctgttggtgtttccatggatatttcaaaagcagtttctggttttgctgaaaggctagaaatgacaactattttcagagtttctaggtcttgaaacatcagtcaacctttcaaagccagcattgatcaagaaggaaagaggtttttctaatgaggaaaataaaatagtaaatgatactttgacattccattagttgtaggaatgtgtgccccaactgactaccttgctttgctctctctctttccctctcttttctaagttttgctaataataaaacttaggaagtacacatttaggaaactgtctgtccttgtgactgatggca

SEQ ID NO: 49549 - DNA, 550 bp, Homo sapiens
taagcccagaatgaagctgctgggtcatcgtagggcacttgcatgctttatgatttaatgactgcctagttgtgcacagaggcctgcccagtctgtttccaccagtatatccagtaaagggtgctgtacacccacctctgcccacacttggcctttcccactctctggtggttgccagtccacaggcgtagagctgccttgctgttctcaggcacatccctctgggcacccacatacagaggtgtctctgtgtgctctgcctgctgtcatcccagctactcgggaggccgaggcaggaaaatcgcttaaacccgggaggcagaggttgcaagtgagccgagatggcaccactgcgcttcagcttgggcaacagagctagactccgtctcaaaaaaaagaaaaagaaaaattttgtttaaggagccatgccgtaagtcacaaaggtattcgcgttcattttcttctggtcatgttatggttttacctcacatttgtatggggtgcctgctgtgcggtagaccctgtggaaagcaatggagaaagagtggtg

SEQ ID NO: 49550 - DNA, 950 bp, Homo sapiens
aaaagaagataaggattcactggtatcagatagttccaggaggggaaacccaggattgaactttttcagccttctatggtaaaatttcctgctctgtcggtgcgccaaagcttttttcagtttcctaaactcccatattcaagaagataagctattttctcttctttctcatccttccttgacaaagcaaagcatattttcattgtctactctgtgtcatccatgcttggttcctgtcctcaaagagcttatagttcaaataaaggagagggagcattttacaagggaattaaaggtaaaagattctgaaagccagtttaaaaagtcgtgagggaggggtctgggagaagctgagcaggggtgaaagggtacgaaacattatggaaggagaacaggggagcaccctgactactgggtggaaacaccaatcagtgggtagaaaccacacagtggtaacactgatcagtgggtagaaaacaatgacagcaggtatatgaggcatggaacacttggcttattgtaaagttttcaaaatatgcagtcctttctatccaccaggggttgggagttgtctttgtatatcaaccgtggaagggctgttttggttcatcattctgtggtctacctgggtagacctgatgcagccgtgtttctgaggaaaggaagaacagcttttgttttgtgatatgtaatggtagatgtagtgccatggaatgatgcagatttcattcagatattcttggatcttggccccaggactcactcattcttccctatatgagcattggtagttacaggttttatccttcctttaattgtaagtcttttgaagccaaaaactgtatccaatttgtcactgtctcctaacagtacttagcagtgtctgatgcatcatagggagtttgtaaatgtttggataaataaagggaaaacaaaaacaaccacaaaaa

SEQ ID NO: 49551 - DNA, 420 bp, Homo sapiens
ggacaaatgaattagacaacagtcatgacatcactgagctactgaaccaatgttaccagctgcttcagatttttactatgtaataaaaagaattctccatttgcttaaacctttgctaatgagttttactcttatggatgaaaacatcccaatataccttccagacaagacaattctattctgcgcttccacatcatgcctagtagcactctgattccaagcgagataagacttattttgcttcaggcgtcttatcctgctttccatgaacaaatacagtctcttcccagggcatcttagcaaatggacacatgtgcttgccaaggtgactctgccatcctgtgtgacgggaggaggaggggtaaagtttggtttcagaaatataagttctctgccctgagcagagatagacagagtcat

SEQ ID NO: 49552 - DNA, 241 bp, Homo sapiens
aaaaccaaaaaaaaaaaaacacccgtcttggtgactgccctacagagcaaagtcctgaagaatattcattctgttgaaaaataaaatggggattaacaactaccaaaaccccttgtaacaagccaactaaaggtggaccctagtacagaccccgcagccttgtgaccaagctacaacccctctctattacaaatccatagggcatctcagcaccctggggacccaacaaaagaggcttacc

SEQ ID NO: 49553 - DNA, 886 bp, Homo sapiens
tgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctggagctccttggaggcaggggctgaccaggtgtgacctcccggtctggcggctctcccctggtgtggcctgccctccctttgacttggggtttgctttttaaaatgaaactagatgagtctaaatcattcggatggtttatccaaatgtgcgtcaacttcgttagcttttagaatctaacacaatgtataattgttacatacaagagtgaggaaattcattttctctagtgcctttctagcacaggttttctcaaaacaaacaaacaaaaaaggaaactgttaagtagtcgtttaaaaaaaaaatcccagtagcgcagtagctttagaacgttaggaagactgtacactttgttgaattacactcacaattagaaactagagagaggcagacacgttccctatttccaggagacagattgcgcttgatgcgccttttttttctgttggtggataaggtggttctggagggcaggcagccttgtgtcggggagtatcctcaagcgacacttggtcatctgacaaggacttgggctgctcccacggctcccagcagcggtaggaaccccatctcggctgtcaatggagagaattttatgataaaagattcacgcaccagaagggtgtctgtgagaacaaggcttctagtgaactagacagtttgtaccat

SEQ ID NO: 49554 - DNA, 753 bp, Homo sapiens
ttaccttcaaacagtttaatttacccagttaatcacaaaagattaaaaaattgctaaatcagaaattctctacctgtaactgatgttttcattgatgatgaatattagaaacattaactatatcacatactccctgaggacatagagtggtgacttgcaaatgttttggtttggaattgtggcaccttattgttgtccctaaatggtttacatattgcacacatttttaatttaaaaacaagaaacaaaacaaccactttaatttcacgcaagcccttttgtgataactgcagacatgagtgtcataggagccagaccccctgactggctgcccagtaaaatggaatgtgtctttaaaatttttggccaaacaaatttagtccttaacctcttcctctgggccttacctaaattgtgggatgcctccgtacttcagtttgcggtacttgagctttagaagcgtgcctgaatggtgctcaagacactgctgtgggcctctgctgacaatgcaagctctcacaaaactgaacgtttggcccatttaccataaagaagcaaacagtccccatcctaaggacaggcctagcctaaggttaacagtaagagcaacattttgttgcttcattttcctattaagctctgggttgctgattgaagcagaattccaatgttttgacacaccaccacattgttagcacgatagggaggatttgattatgggagaacaagtccaaaaacggtaaattgacaaaa

SEQ ID NO: 49555 - DNA, 4538 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49556 - DNA, 333 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacggtgaggagctctgaggagaagaatcttgggccctagattttgaggcggcctgggaggggcctcgtttttaaatctctcctacacccgccccttctgcccggggatggtagtttctcagagtcaacctattggcattatgtggcaaattagtcatgccctgaccaaagtatttgt

SEQ ID NO: 49557 - DNA, 5368 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49558 - DNA, 5255 bp, Homo sapiens
ggggaggtattgctccggagggtgttactcgttagcgtcagtttttcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49559 - DNA, 5336 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaagggtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49560 - DNA, 4561 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggtatttttagtcttcttctaccagacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49561 - DNA, 5273 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacggcatcctgctgtggaggatcagaggaaggaagaaactgagaataagctagaaaaatcatctggtcaactggtactgtgcagacagggggtgagactatccaactaaaagatgcacatgtttagacaggtattgtgagacacgcctaaaatcaattattatggaggtctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49562 - DNA, 4753 bp, Homo sapiens
gcgtggtcgcggccgaggtacgcgggactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49563 - DNA, 4721 bp, Homo sapiens
  misc_feature (86)..(86): n is a, c, g, or t
tcatggatggtgaagatctgcctagtgttactgatattcgaagacctcggctctacctcctcaagtggctaaaatctgataaggcnctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatattaaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaatggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaactattttatctgtgtatttc

SEQ ID NO: 49564 - DNA, 2703 bp, Homo sapiens
tcactaaattatccttagatctttcatcttataggcatgaatatgttgctttttaaaaagtgtcttcctcctttgttacatccatgtgtgtaagtgagcatctgtgaacttttatcagtaacctacttattgacattatgtgttgttcctttattcatcagtgattatttaaggacagaagactaggattaaaataaaaatgataaaaacaaaaataattgtttccatagaatctagaaagaaatacctataatattagaaaacaaaagatctcagtggtgagaggaaatatattttgcaaaataacccattgggcaatttgaattacatatttaataaataattttttacctactaggttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49565 - DNA, 2835 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcaggtaagcatgattagagagggtgcctgccttctcttattgttatctggtttttcctgtgactctttaaacagcatcaccctttgaaaagcccagtggtttatactgtttgtgaggagaaagagaaaagcataaaaggtaaggagggatatatgaaggaaaatagaataaggaaaaaaaagaacgcctaggagctggaaacttcactttagccctcaaaccatttcctggctttaattatagggcaaagttgattacaaatgcatttcttgcaaacgtttttcgaataccacaaaggaaaaaaaaagactagcataatcctactagattacatgtcatgagaaaaatagttttgtaatataaagctgctttcatttttaaaaattaaatatgattgttaccataaaa

SEQ ID NO: 49566 - DNA, 2150 bp, Homo sapiens
ttttgaggaaaataatacatgcatatttcctgtgctcaatagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49567 - DNA, 1340 bp, Homo sapiens
tgctggcgaccgagaggacccccaccgccgatgggtccagatagtttacttttccaagtttactaacaagtttgccaagttcccccagtttattaccattagaccatacctttttgtccaatcatttaaaacaaatttttatataataagttttatttgtatgtaataaattttattatataaaaataagttttaatatatattatataaaaagttttaataaatacctaatatattatttaatatgataaaacttatattaaatgaaattttatgctgttctcttgtcaatctgtcttttgttatcttgctggtgtgcctgtcatgtgagggactgcaatctgatatgcctattttccacagtcaaagcaattacaagagaattgttacaattacccagttatgtcaagagatttttttttaattcactaaggtagagataaggagaatgtattaaaataggatattttaattataaatgcatgactggggagggggtattgtttttgaataaaatatgaggttatttgccatgacaaaaaaaaaaagaagtaggaaaatcccatggaaatttatgttccttctaacttttaaaactacctaaaaaatataattgatttaaattatatctcaatattccccattcttttatatccccttaaataggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49568 - DNA, 1713 bp, Homo sapiens
gacccatgcgtccgttgggtgagcttcactctatgagtcaagacggtagtacacggaagtgtctcattcagctagccaggggactcgcatgtctgaccgcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49569 - DNA, 1535 bp, Homo sapiens
ctgttgttgttctacatacatttaaagtcagggcacatgcgtcactgcttatttttcttacttgacatattccctgcatttccatgtctgcctgtcctttagataaacagtaaaagtttcccatgtgccagtatttctcaaatggtttacatcagaatcacctggaggacttttaagctagattgtttggtcccatcccagggattctgaatcaacaggtttgcgatgggtccagatagtttacttttccaagtttactaacaagtttgccaagttcccccagtttattaccattagaccatacctttttgtccaatcatttaaaacaaatttttatataataagttttatttgtatgtaataaattttattatataaaaataagttttaatatatattatataaaaagttttaataaatacctaatatattatttaatatgataaaacttatattaaatgaaattttatgctgttctcttgtcaatctgtcttttgttatcttgctggtgtgcctgtcatgtgagggactgcaatctgatatgcctattttccacagtcaaagcaattacaagagaattgttacaattacccagttatgtcaagagatttttttttaattcactaaggtagagataaggagaatgtattaaaataggatattttaattataaatgcatgactggggagggggtattgtttttgaataaaatatgaggttatttgccatgacaaaaaaaaaaagaagtaggaaaatcccatggaaatttatgttccttctaacttttaaaactacctaaaaaatataattgatttaaattatatctcaatattccccattcttttatatccccttaaataggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtta

SEQ ID NO: 49570 - DNA, 2395 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaagggtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcagaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaag

SEQ ID NO: 49571 - DNA, 1540 bp, Homo sapiens
attctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagaattgctctacagtcaataacaggcagtcagcgtattgaaatagaagagttacagaatgaggaagaagaactaagtccacctctcatggagtacaatataaatgtgaaatcacaccctgagatacagtttgccacaacacaaacacacacacacatcaccaacacacc

SEQ ID NO: 49572 - DNA, 346 bp, Homo sapiens
ctgttttctctaccaccatccagtaagggcatggccaattcgtcttctttaacatgagtctctaaagagatatggcacctaccaccattaccagtctttgatacattttggttacactttcagacaataattcaattgttagattctttactactacaatttgtgttctttgtgagaagatgctcttaatatacctcattttcatttaaaataggcatcctgctgtggaggatcagaggaaggaagaaactgagaataagctagaaaaatcatctggtcaactgggtaagagaaagtttaattttcattaactgttagttaattgataataactaattatatatgc

SEQ ID NO: 49573 - DNA, 4246 bp, Homo sapiens
gatgagattgatgattctttctcctggaaaacctttcatcacagagattcatctcagcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagaccccttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggacaaatcttcaggacttgtgaaatgaactgaaagagcttgaagcagatggaattttaatagttacactatatatgctcttagtaggtttttttcttgtagtggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagtataataataat

SEQ ID NO: 49574 - DNA, 1822 bp, Homo sapiens
  misc_feature (1467)..(1467): n is a, c, g, or t
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtagtcccagctacttgggaggctgaggcaggagaatcacttgaccccaggtggtggaggttgcagtgagccaagattgcaccattgcactccagcctggcaacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgngccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctc

SEQ ID NO: 49575 - DNA, 2075 bp, Homo sapiens
  misc_feature (1916)..(1916): n is a, c, g, or t
  misc_feature (1920)..(1920): n is a, c, g, or t
  misc_feature (1924)..(1924): n is a, c, g, or t
  misc_feature (1926)..(1926): n is a, c, g, or t
  misc_feature (1932)..(1932): n is a, c, g, or t
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggtggatcacggggtcaagagatcgagaccatcctggccaatatggtgaaaccccatctctactaaaaatacaaaaattagctgtgtgtggtggcacgtgcctgtagtcccagctacttgggaggctgaggcaggagaatcacttgaccccaggtggtggaggttgcagtgagccaagattgcaccattgcactccagcctggcaacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaactcctgacctcaggtgatctgcccacctcggccttccaaagtgctgggattacaggcatgagccactgcacccagcctgatcctattgttgcactatttatggagcaacaactttgtacaaagaacaagctttgtacagagaacaagcttggctttttctcccaacgccgaggatgctgttgatgctgccacgtaatagcataattttgggtgtcctcaaggacagaacttccactttgaataatggaagttagaacaatgaatttcacaggggaataaatattaatgactgacgtgaaaaacaaaaaaaaaacaaaaaacaaaaaaaaaaaacaaaaangaanagananaaaaanaaagaaaaacaagcaagaaacaacaaaacaaacaaaaaaaatacaaaacaaaacaacgaaaagaaaaaaacacgacaacgaggagccaggcgcggcccacagaagatacacccagcgaggaacggacaccagcatctagcacc

SEQ ID NO: 49576 - DNA, 1015 bp, Homo sapiens
  misc_feature (589)..(590): n is a, c, g, or t
ttttttggccatcatgaggatctaacaacagagtagaaggaaggatgccctaggtcagcatgcagggtggtgggagggctttcatcttccttacccaagcctctcttttcacttttctagaagtccagaagttgttatatgatgaaatagcctcctttaacgtttatttctgggtgccaagggaggcccattcctctaacattctcataatttttctcaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaacagttnnggtagtctgatggagatgagtccgacgtattcagtcctcacggaaggactaggctgaacttgcccagtgttagcaattccttggaactagaacagtggaatccgagggagaaggtgatatgggccataattaacttttgtgtttgtgtgtgtgtgtatgtgtgtgtgtgtttgcttctgagacagttttgctgtcctgggcaacaagagcaaaaactccctctcaacaaacaaaaacaaaacaagtgtactaagtccagtgcggtggctcacacctgtaatcccagcactttggaggccaagacaggaggagcacttgagcccagcatgagcaacagagtgagaccctgtgtctacaaaaatttttttaaaaattagccaggcagcagggcgcagtggctcacgcctgtaattccagcactttgg

SEQ ID NO: 49577 - DNA, 1935 bp, Homo sapiens
  misc_feature (1776)..(1776): n is a, c, g, or t
  misc_feature (1780)..(1780): n is a, c, g, or t
  misc_feature (1784)..(1784): n is a, c, g, or t
  misc_feature (1786)..(1786): n is a, c, g, or t
  misc_feature (1792)..(1792): n is a, c, g, or t
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggtggatcacggggtcaagagatcgagaccatcctggccaatatggtgaaaccccatctctactaaaaatacaaaaattagctgtgtgtggtggcacgtgcctgtagtcccagctacttgggaggctgaggcaggagaatcacttgaccccaggtggtggaggttgcagtgagccaagattgcaccattgcactccagcctggcaacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaactcctgacctcaggtgatctgcccacctcggccttccaaagtgctgggattacaggcatgagccactgcacccagcctgatcctattgttgcactatttatggagcaacaactttgtacaaagaacaagctttgtacagagaacaagcttggctttttctcccaacgccgaggatgctgttgatgctgccacgtaatagcataattttgggtgtcctcaaggacagaacttccactttgaataatggaagttagaacaatgaatttcacaggggaataaatattaatgactgacgtgaaaaacaaaaaaaaaacaaaaaacaaaaaaaaaaaacaaaaangaanagananaaaaanaaagaaaaacaagcaagaaacaacaaaacaaacaaaaaaaatacaaaacaaaacaacgaaaagaaaaaaacacgacaacgaggagccaggcgcggcccacagaagatacacccagcgaggaacggacaccagcatctagcacc

SEQ ID NO: 49578 - DNA, 752 bp, Homo sapiens
gcactcgggccggcggacagtgagggcgcggtaagctccccgcaaggagcccctgagaaactggtcgctttttgtcctagatataggggagtccaggatggtgtggtggagtctttagagtcgaatatgacccgaggcaagctcatattcaggtttggggcaaggagctttgattgacccttaattttttcagtggaacggaaaacttcggtaaaatagcttctgaccttcggaacagatggattcaccttggaaaggaaaaatctctttctagaagagtcttgaggtctggcacctttaggcttaacgggggacggctgggcgtcagaggaggaaatccttcattccgaacgacttccctttcctcctaaatccttctttccaaatctgtaaaagactacatctactttgctggaggtggtttgacactcatgctccttgagaaggaggtaatgagctgtagggcagctcttaaaaagttacccttggacgggcgcggtggctcacgcctgtaatcccagcactttgggaggccgaggcaggcggatcacgaggtcaggagttcgagaccagcctggccaacatagtgaaaccccgtctctactaaaaatacaaaaaattagctgggcgtggtggtgggcgcctgtaatctcagctactcgggaggctgaggcaggagaatcgcttgaatcctggaggcggaggttacagtgagccgagatcgcgccattgcactccagccggggcgacag

SEQ ID NO: 49579 - DNA, 770 bp, Homo sapiens
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagatggagtctcgctctatcacccaggctggagtgcagtggcatgatctcagctcactgcaagctctgcctcctgggttcatgccattctcctgcctcagcctcctgagcagctgggactacaggtgcctgccaccacgcctgtctaatttgtttgtatttttagtagagac

SEQ ID NO: 49580 - DNA, 1393 bp, Homo sapiens
  misc_feature (967)..(968): n is a, c, g, or t
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaacagttnnggtagtctgatggagatgagtccgacgtattcagtcctcacggaaggactaggctgaacttgcccagtgttagcaattccttggaactagaacagtggaatccgagggagaaggtgatatgggccataattaacttttgtgtttgtgtgtgtgtgtatgtgtgtgtgtgtttgcttctgagacagttttgctgtcctgggcaacaagagcaaaaactccctctcaacaaacaaaaacaaaacaagtgtactaagtccagtgcggtggctcacacctgtaatcccagcactttggaggccaagacaggaggagcacttgagcccagcatgagcaacagagtgagaccctgtgtctacaaaaatttttttaaaaattagccaggcagcagggcgcagtggctcacgcctgtaattccagcactttgg

SEQ ID NO: 49581 - DNA, 855 bp, Homo sapiens
ggccccctggaaccaatgagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcaccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctc

SEQ ID NO: 49582 - DNA, 302 bp, Homo sapiens
taatttctttgttttaaatggtgtcatatcataaacattactacaagggaccaactgcaggttaatcttagtttgggaccacagtcagttgtaagcaagatggttataaaaaatgttgaaaaagagacattcttccttttgtagcatcttgcaagaacatttatattttaatatgtaaaacatgaaacttcatagtgtaaaattttagaacaggtgtcgcctatttccattttgaaatttccttaaaaatatatctgtgcatattaatgatgggagttctatgttctagtcttatgtattaa

SEQ ID NO: 49583 - DNA, 751 bp, Homo sapiens
gagctcggtaccctccccgtacgcccaaactatatcaccccgtccagcctccttttccttagctcccttcacattctagtttctgcctgagccatcaggccctgtggcccagaccaggcatcttgaactatatcccagaccctcctcatgaacagaatcactgctcaaaagtcctccttttttcacctgccctgtgctctagtctagattctgatttcttgtggtgagttggtgttgccttggatttcttgtgcctgctcagatctgtggatttggccctaggtcctttttctttcttcctgttggcctcctcagctccctccctcctttctgccaggtattccctgcaggcctcagcgtcagggctacctctattgacaggggatccttgggcgttcgggccatagtttttctttggtgaataaatatgtatggcttacaaaacatgtgtttctaaatttatgaaattatatgtatgtttatacattcattcgtgctttcatttagccaacatttattaagttttttacatagcagaaaccacttcataactgtgagactctgggataaatcacttaagtttcctgagtgtcattttcttctctgtggaaatgggagggtaataatgattgggctccggtgtgggtcctggcaccttggaacaaggatagtgggactttaaaggggctttcatcaggatggccagccccagaaggtgttccagtgggtaagaatgtcccccctgatgcca

SEQ ID NO: 49584 - DNA, 509 bp, Homo sapiens
gggcgacccagtgagactccgtctcaaaaatatatacataattttttttaagtaaagagttcattgataattgattagcatgtatataaagtaaaagtgtgaaatggatataatttcaggctttaacacatattaagacagatttgggattatcatacctagtggattatactatttaaagatagatcatttgttaagaatatggggtaggctgggtgcagtggtcacagctgtaattccagcacttcgggaggctaaggtgggcagatcgcttgaacccaggagttaaaggccagcctgggcaacatggtgaaaccctgtctctacaaaaaaaaaaaaaaaggaaaaattagctgggcatgtggtgtgtgcctgtagtcctagctactcagaaagttgaagtgggaggatcccttgagccctgggaagttgaggctgcagtgagccgagattgtgccactgtactccaacctgagtgatgggactgagaccctgtatcaaaaaaaaaa

SEQ ID NO: 49585 - DNA, 381 bp, Homo sapiens
gtctacaccccaaagcttgttgggggtgctttaaaattttgaagacagactttggaatcctgataccacaaagcagacttttaattcacatacacgcccagaagcacccaagaactcatgagaggctctttggcctacagcaagttggtgacacggacaagtggacaaggggatggataattcacgaccccataaaagactccaaagaagtcacacttgactgtggccaagggtcttcaacaacatgtctagagactctcagggcctttccaaaagggatcttagagtccccacttcttccattcagaggattaggaattttgtagccaagtatatgaactcatgctctccaggcttcacaaggggaggggcagagttggg

SEQ ID NO: 49586 - DNA, 339 bp, Homo sapiens
ccacaacactgaaaagggagaagttaccaactaatgctgagagcaaaactggtagaggtcctactgaaaaaacaaaaacaaaacactacaaaacaaaacaaccaacaaccatttaatcttatttcaaacctaatgcaaacattctcaaataaaatattagcaaacagaattcaaaaatgcagctgttttgatagaatgaaatatccaagacctgtgagacaactgtaaaaggtgttaacatgtataataagaatttcagaagagagaaaggaacagaagaaatattcagacaataataactgagaatttatccaggaagctcatagaatactgaataga

SEQ ID NO: 49587 - DNA, 225 bp, Homo sapiens
gtcccttcactacgccgtaattgtgaaggccagcaggtctgagacacaatggaagggataggaaatgccacctgtaatcccagcactttgggaggctgaggcgggcggatcacctgaggtcaggagatcgagaccagcctggccaacatggtgaaaccccgtctctactaaaactacaaaaactagccagtcgtggtggtgcacgcctgtaatcccagctacttg

SEQ ID NO: 49588 - DNA, 1531 bp, Homo sapiens
  misc_feature (1492)..(1494): n is a, c, g, or t
  misc_feature (1500)..(1500): n is a, c, g, or t
ttccctaggcattctcaatacacatgggcttttgttcacatagggcataaacctggaatatcttgctctgtttttccaccttcatttctaccttctgtatgtagaaatcccatttatcctaagggaccaataagatattaactcttggcaatctttttcttcattcactaatcagaattcattagcatttttgtttgtgataaacagtactttttgtacttctgatatttggatgtatgttcttatgttttcagtaagttgttggtatgtgtcatctttactagattggaacctcttagatggcaagattgtatcttactcaccttggtatcaccatagcaggttgttttgtacataactgcaggctgagtgagtgactgattgttgagcaaatgactgatatgagacatactagagaaactctttcttgactttcaggtggagcatgtcaaagtgaaaaataatcttagatgtgggtaatttttttttatcctgaagggaaaaccatacccacttgagagaaaatcgtttagtaatgaaattagagaattactaaatatcattgcacagccacaggactataagcagtataatcacaactattggttttgataaatacaaagttggtaaatgccattgtccaagttaacaagtcacagtatcaagtgtacttggttgtgaatgtcaggtctgaactccgtgctgttggttaatatcataaccatagttgtgttagtgagcaagatatttgtgtttatttttaagattttattaatagtaaatcacttttattaatttcttatatttatagagaatgataagagaaaatgaagtatcttaatgaaaggaaatgaccattttatcctttttgctgcatttcacaaaatgaatattaggttatttataacaaaaacatgtattaggttgttaagagattaattagtatataaaaaccacacaagaagatttagcagttatttcacagatagagggtttactttttcaggaaagaaaatgcatacccgtaactagaacacattctgtctggaaggatacctttaccagtgactgtgctgggtagtggaaaatggcaccagctttgaagttgtcttaacctggattcaaattccatatgctctcatcattaactctgaacctcagcttccttgttggatgagatttttattatgattcaaaagaagaatgcaggagcaataacataaactttgatttgagccaaacttcagttcgctctgactcataaaatcatggaaccagtgagataatagactaggtgttatgtttctcatcttgcttggacaggtttaagctattaaagaaatttgaagctggtcatagtagctcacttctgtaatcccaactactgggaggctaaggtgggaggattgctttggtccaggattttgaggctgcagatcacaccactgcattccagcctgggtgacagagcaagaccgtatcatgaaaaccnnncttaancatgtcaggcaatcccggcgggcctcccggc

SEQ ID NO: 49589 - DNA, 627 bp, Homo sapiens
aactgctctagcaaattcatcaaacctgaatagagcattgtgggaatcccaatttatagctagttgatcagaagttccttaggcccagacttgtgactggtttctgaaggtggggcagggcagtcttgaagactgagcccttaacctgtgggacctgaggctgtctacaggtagatggtatcagaattgaattagcggacattcagctggcgtttgatgcttggtgtgtttagggggaattagaaaacccagacatttggtcacagaagtcttctgtattgatgattgttactgttaagagagaataggaaaaaacaaaatgttgctttttccacactcaaagttcgtttttattatcacattaaacgttctgtcataaaatttgagcattatattgttcaaatgagagaataattagtcctgcctggttaagaagaggggttgtgataactaggaaaaacttgatagaaaaagtaaaatttgacaacatctcatatctatagagtgacttccagaggaaaatagatgttcaaagactacaaattatttgagaggagtgatgtacaaacactggagggtagacaatttatgaaagaagttggcaaaattttaataaggaatgttgga

SEQ ID NO: 49590 - DNA, 625 bp, Homo sapiens
ctgagtttctcttgcccaggctagagtgcaaggacaggatcatagcttactgtaacctcgaactcctgggctcaagtgatcttcctgcttcagcctcctgagtaactaggaatacaggcatgtgccactatgcacacctaatttttaaattttttgtagggaagggtggggggtgtcaatatgtggtccaggcttttcttgaactcccggcctttaatgatcctgctgtgttgacctcccaaagtactgggattacaggtgtgggccactgcccctggccagattcttttaaattttaagtactttaaaaaaacaaaaaacaaacgtagttcctttaccattaatcacacttcaaaaaagttaacagtaaatctttaatataataaaataccaatcagtgatctatttttttcaggtcctttgtatagctagtgtattacaatgtagcctttcccccatgatctatttctcttgctgctctgaataggctgagtgggaagatgtaggaccggatatgtaggtttgagatatgtcagaataataatttcagtttaatttctggatttaccttagttcataaattgagaggattctgttacctttagttatatttaggatacctaaa

SEQ ID NO: 49591 - DNA, 429 bp, Homo sapiens
ataattttgaagaattaatttaactgcagtatttctgccttttatagttcaaggactataatgaaataagaatgaagtgaagcatgtaagtatctagtttatcaatagtctgtttttatgttgctctatattttctactttcttaagtagtatcaatatattgtccaatagggtcactactagctgtgagtggcaatttaaacttaaattgctggccaggcgccgtggctcacgcctataatcccagcactttggtaggtcgaggtaggcagattgtttgaatccaggagttcgagaccagcctgcgcaacatggcgaaatcccattgctacaaaaaacaaaaaaaatacaaaaattagctgggtgataccctgtccctcccccatcccacctccagctgctccaaatgttaataaatccatctcaaaa

SEQ ID NO: 49592 - DNA, 288 bp, Homo sapiens
atgagcctctcctgtcttcaaatagcctggtattttccagcgttgttaaggtaggagggggaggaacgttttgtgagaacagctttaagattggaggaggctggaccagtagacctgtgtgaaccataggttcagttaagagagcaaacccatgagtttgtgagatgcttctgtgttctcctagcttgtgagcatgctctgttgtgtggcggaaaccagactatttcctttaacagtaacagctcagaggcagtattatgagcatttgaaatcatcattcaacaaaat

SEQ ID NO: 49593 - DNA, 237 bp, Homo sapiens
ctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctgg

SEQ ID NO: 49594 - DNA, 263 bp, Homo sapiens
cagcccgggcaatagagtgagatcctgtctcaaaaaaaaaaaagagcaattataaatctaaaattatattatccatcatatttaactgctcacaaagtatgttgtttgaaacacaaacttaacaatgagcaggccccggggctgcaaacagggacttacccttccttggaagtcaagacagacttttcagtctcagcttctttctaaagtgcctgcagtctacacatggttcaaagtgcacttaaatgagtgggaagaaaaaa

SEQ ID NO: 49595 - DNA, 736 bp, Homo sapiens
ctgcatgtaagtggcaaagatgactgtctgaaaatatatacctacttttttaaagggctatctcaagccattctggagaagcaccaaaagccactttgcttatactgggagaatagtttgctttccctaatttgtgatgagtgaaacactgaacagagacatagaataatattctgtagttcaggggttggtgtaatatggccagtgggcggaatctggtcctcagactgattttgcaaataatcttatagaaacacagcaacacccattcattacatgttgtttatggttgctttggggttacaatggcagagttgagtagttgtgacagagatcactaggctcaccacatctgagatatgtactgactgaccctgtacagaaagtttgctgctcttagaggaatgtgtgtttctagtgtcagcaataaacttcttggattgttttgttttctcatctttacatgatagttgcagactagttgatccttgtgacctgtttttgaatgccactgtgtattctgtcagggccctctgattctgtttcttatggtgctgaatgcacaatttaatgccctggaatttccttctgtcttctgctaaactcatgcctcttcagatagttaaaatcctgttctaccttagaagtctccagagttattttcctaaattaagaagaactggctttgaagttactcattatgccacacacaatggttgaaaagagcatctcttat

SEQ ID NO: 49596 - DNA, 413 bp, Homo sapiens
  misc_feature (310)..(310): n is a, c, g, or t
tgtttacttaatcttttcatgactaatgaattttctgcctagaaattgtaaaggaaaagacaggcaagattttttttagagatacggataccttgtatgatactgctcacaaatttcctgacagaagtgttttcgcttatgcctttttagcaagaatagcaaaatggatatatatgtatgtatgagacactcctgggaaattacaatagcatcctgttgttatgcacagagtacttatgtcagggaccatatagaatgagaatttaggccagggcgcagtggctcacaggcctgtaatctcaacactttnggaaggctgaggcggtgcggatcacgaggtcagggagatcgaggaccatcctgggccattgatggaaaccctgttcttcttactaaaaacacaaaaattagct

SEQ ID NO: 49597 - DNA, 385 bp, Homo sapiens
gagccaatttgttcaggtaagaactaggaatgcttcataagtcatgaggatgtttttatatatatatgtggcaaacaaatatgacagtgcttgctgtgtaacagatgttccataataacctgtaaacattcctgctggagttagtttgtaacttcaagtcagagatggaaaataccaatagtgaagaaataacattgattcttcatgtgcagataacattttttttccatgctgcaaagctaaattttgctgaatttaaaaagaaattttggttcttttatttcctaattacctttagttttgtttgtcttattatgtgacttctgtgtattcatcacagcccttctccttctttttctatgtgatggctacactttgctcactg

SEQ ID NO: 49598 - DNA, 272 bp, Homo sapiens
ctgttaaattctgtaattcagttacttgaaatgatgtttgcatagttagcagtaaatatttctattctgcttatttatgtatttatttatttggctggactggaacaaatatagttaactgatttgagtatttgttaatgcaaataccaaagcccttagccatattattgtaaaactattttaaagtatcataatgattttaagatttatttttgcctggtgtatgtggctttttatatgatcatttatgaggataaatgattataataata

SEQ ID NO: 49599 - DNA, 420 bp, Homo sapiens
  misc_feature (414)..(414): n is a, c, g, or t
  misc_feature (416)..(420): n is a, c, g, or t
gtcctcaaggttcatccatgttgtagcatgtgtcagaaattccttcctttttaaggctgaataacattccattgcatgcatagactacattttgcttctctgtccattcgctgatgggcacttgggctccttccacctcttggctgttgtgaacagagctgcaatgaacatggatgtacaaatatctgttcacattgagatctctctcctttggaaaaggcagggcaaatgtgaaaaaaaatcatactttcctgatttattgtgactcaaaatttcccaaacctacttcttatttttgaaaagtagatgtcacaattagtaaaaatcctgaaaattttgagtgaaatatgttaggtgatttcccttcgtaagaatataaaagaagtaaaataaaatgatgctgaatctttaaanannnnn

SEQ ID NO: 49600 - DNA, 845 bp, Homo sapiens
ttactgttgccttcacatttagctattctttctaattttttctccaaattttttcgtaacatgcatgcacaggttgagtatcccaaatacaaaatgctccaaaatctaaaactttttgagcaacagtatgacactcacaggaaatgcccattggagtattttggatttttggatttgaaatgctgaactgatataatgcaaatattccaaattctgaaaaattcctaaatcagaaacccttctttttttttttccaaaatcggaaacacttctggtcagcatttcagataaggggtactcagcatgtactggtagttgttgatccctctctcctccccgcctcctgtttaaggcagtatctactgattctttttctttggaagatgggaattttgccatcctcctcctcccacctccttgtgcacatttgccctccctccatctttccattaaagttctctcattgggagtcaatgtgccatagtgttcagagccaggctgtctgccttcacctcccagctctagcacttagttgctctgtggcattggacaagttatttaacttttttgtgcctacatttgcacatttgggaatcctccttggcatctaatctgtagggttgttgtgaaattgaattcaaacacataaaaattgcttagaatggtgtatgtcgtatggaaagcatttgttatttcttagcaaatgacaaaattaaattttaaaaggttattttttaatctcccactatggttttgaactttatataaatggaattagtatacacacacacatacatgtcatttgtttctaggatgattagactgacatatggaaaaaaaaaaga

SEQ ID NO: 49601 - DNA, 303 bp, Homo sapiens
catcatcactctcggctaatttttgtatttttaatacagatggtgtttcaccatgttggccaggctggtcttgaactcctggcctcaggtcatctgcctgccttggccttctaaagtgctgggattacaggtgtgaggcaccacgtcccgctgggagaataatgttatttaaagttagatgttgattaattaataatgcatattgtaaaccttagggcaaccaccaataaaatgtgtaaacatgggcataagtaataggttgataaaagagataaaatgaaacaatgaaaacaataagcacaa

SEQ ID NO: 49602 - DNA, 532 bp, Homo sapiens
  misc_feature (24)..(24): n is a, c, g, or t
  misc_feature (65)..(65): n is a, c, g, or t
  misc_feature (78)..(78): n is a, c, g, or t
tgattcccggaatttaaaaaccgncctaacctaatagggaaattttggccctcaaaggccaaaanaatcggggcaccnaaaaggggatccttgctttcttcaacctcaattggatatcttttttgagctcactttctccagagtggtgggaaagtactcactgtcaatcaggatttcctcagtcacttcagggctccctcctccttggatgtgcgtctaagttttagattgtttatataaaaccttagggtcagctgaggatgggagtgggtgggggatatctttggttgtcatcatgtagccatactggtatccatggcaacttaccattcatctggtccctggtttgtagtctatggagatcatgtctgcgatctttccaccccaactgtaggtcttctccaggatttgaggctctcagcagcatgctgatgtgtgagcagacttgatgaggcagcctcatgccggcccgcccaggtgatctgtgtggctgtctctccttctgctcctgcaccatgccgggcatgagata

SEQ ID NO: 49603 - DNA, 411 bp, Homo sapiens
cccgtttaaaaatggggatccccatcagcggcctttcaggcagctctgtgggggtccccagggctcttctgagtacattgagaaacttcctttaaagtcaatgtatttgagagttagatatataattatcttttgcaccttcttcatgtagtaatactacactccactttaaaatttacagcattgtgtatttgcttatgctgtaaatattgcttgagcacctactgtttgccagaccctagaatagacaggaggaggaggtgacttaaacgtggtaaggtctgaacaaaaggttgaagtgtgaatagaaaacaaccaggagggcgttccaggtccagtagactgcaggggaaagctggaaagctgggaggaagcagcctggcagatcgggaagatgggggtgggtgcact

SEQ ID NO: 49604 - DNA, 180 bp, Homo sapiens
aaagcattgagcttcctctaactgtaccactgtaacttaaaatgcatctgaagctaaaccatagcatttcatgcagttgctgtgaatatgactttacaattgctttacgaagattctacctcacagataataatttattactgtatgatattcctctttgactaaaactttggatttttt

SEQ ID NO: 49605 - DNA, 433 bp, Homo sapiens
ggtacagattaggtctcactgtgatgcgcagactgggctcgaactcgtgggctcaagcaagccttccatctcagcttcccaaagtgttggaattataggcatgagccaccaggcctgctccctggtccttttaagcatatgggttttcaaatatgttagagcacctaagatataaaataataagatacaaaaaaaatacatagctcttagctagatcatcttaattgaaaacttactgtgtgtgtgctagacaccatttttaaatctttttcttttttaacttgttttttttgagacaaggtcttgctctgtcttccaggctggagggcagtggtgcaatcagagatcactgcagcctctaactcctaggctgaaatgatcctcttgcctcaacctcccgagtagctgggactacaggcacacacgaccacac

SEQ ID NO: 49606 - DNA, 275 bp, Homo sapiens
tagacacccagagagggttgggtggaggagcttgaggctggggatgggactggaggtggagcatgccagaggccctgggagcgctgggtgctgagcccgtgaaccccctggccagccggacgttgatgcaatatggctttgtccagaccctatccagctgctgccccatctccaagagcctcgccctgctggaagtgcactgctagtctggttcatcagccactctgcacaggacccctgcccaggacccagggtctgcattttaggccatcctt

SEQ ID NO: 49607 - DNA, 902 bp, Homo sapiens
cttcatttgtccatccataaaatgaagcgagtaaggcctgatcccacatgagagaaaccaagtggactcagacacagatgaagggattgtacgaatcaaactgttggtatcactattggtttcctccctgggagaacctgcagccaggagctagcattcttctcagcccttactgtgaactgagctgagttgactgggctagaccaggctctgacactctcagggacctgaccacccctactcaagtctggaaggacaggtggggctggggtacacagcagcagtgatccctgtcttcgagcggcccccgccaacccactgacccctatgctgccaggggcctcctatcccaagagctgaagcttggggagactggaccatctgattatctggaaccctgagctccagtcatgggttaggaatttgggtgatgacctttggtaaattctagaaggaaatcccccaaaatccacccacaaagcatcaagtcccctaaactgttagaatccttcttgtctaagtcagtgaattcttgaaaatatatatcaagcattctttcctcctaaacacacataaaggtatgtgtgtttaaaatacctttgctctagaaagacagaaagtagaatagtggttactatagggggcttaggggacaggggaatgaggagttactgcttgatagataccgagtttcagtctggaaacatgaaaatattattcaaacagaagatggatggtggtgacggttacgcaacaatgggaatgtgcttgatgccaatgaactgtacacttaaaaatagttaagctggggctgggtgaggtggctcacacctgtaatcccagcactttgggaggctgaggcgggcggatcacctgaggtcgggagttcaagaccagcttga

SEQ ID NO: 49608 - DNA, 389 bp, Homo sapiens
aaaaaacaaaacacacacaagtttccaaagttttaaaacccaaaagaaaaaaagaagcaataggtaatttttacagcaaagaaaagaactcaagagcagttaaattgctacttttccatagtttttcaagacaagcaaaagtaagtagttgataattttcctttcctaagagacacatagaaatgaaatgcacctcatttaaataacatacaactactccttcatccccaacaagtgacctctactgtcagttgttttacattaacaaattaaggtaacatcactagttcttagtttggtcctcataaaaggcatttttttcaattaatcttgaaatgtatttgccttatataaggctttaaaatcacagcattttataataatgtata

SEQ ID NO: 49609 - DNA, 663 bp, Homo sapiens
gccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccaca

SEQ ID NO: 49610 - DNA, 498 bp, Homo sapiens
tcaatattttaaatcttcaggaatagatggtgaattctaccaaacatttaatgaaaacaataatcctaatcataatcataaactgatatggtttggctgtgtccccacccaaatctcaccttgaattgtaataatcctcaagtgtcaagggtggggccagtggacataatcgaatcatgggggcagtgtcccataagtgaataagtctcacgagatttaatggtttttataaatgggagttcccctgcacaagccctcttgcctgccgccatgtaagaggtgaatttgctcctcattcgccttccaccatgattgtgaggtctccccagccatatggaactgtgagtcagttaaacctctttcttttataacttacccagtctcagatatttctttattagcagcattagaaccaactaatgcacaaactcaaccagaaataaaaaagggagggaagacttcccaactcattttatgaggtcagcataaccctaacaa

SEQ ID NO: 49611 - DNA, 278 bp, Homo sapiens
gaatctctaagaaggcaaagcaaccaacaaaaggacccaggagaaggtgccacagtggggattcaggctgaggaggggaaagcccctttgacccagggagctcacacaaggcaagggcctggacaccagagctcaggtgtgcagggatcctcaccaaagtccaacaccccaacacagaaaagcctcttactgcatagggggaacaagaatgtgaaacgagagtttacactccctctttccatcccaagaacccaacagagggtcatgggcaggtgctc

SEQ ID NO: 49612 - DNA, 378 bp, Homo sapiens
tggagtttgcttaatcaagcatcagtgtttctgtcagtgcttggaaatccatgtcctgctgttgttcatctgtcagcagaaagatcaaacctgcacccttaacttcacactgcactaataagatgatgcattaagcatctcataggtaatacctggtgtgttgcaagtattgtttttgtaaagccctcatttgtgcataactcacacaaagtattccaatttaaaaatatcatgcttggtctggcacagtggctcacacctgtaatcccagtacttgggaggttaaggcaggaggatggcttgagcccaggagtttgaaaccagccttggcaacatggaaaaatccagtctctacaaaaaatacaaaaattagctggg

SEQ ID NO: 49613 - DNA, 354 bp, Homo sapiens
gacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacag

SEQ ID NO: 49614 - DNA, 333 bp, Homo sapiens
ttatacatgaaaccaatgtatctttcacatctcaagttgcttggctaaagacagagttgcattagcttaagttacagttcttgaggatacatgaggacagtataatattgctacagaaaaataaggtactactgatgggaatttatatgtactctcatcttttgcattcctaacaaatctgaagaagaaaattgagctatttctgaattaagcatttgcaatatttgaacttcaatttgaagaatgttagttcagatttaaattcagttataggtccctggttttaaactataaagtggttattgcaaatctcacattgcatctggaatataa

SEQ ID NO: 49615 - DNA, 402 bp, Homo sapiens
ctccctcatttgtattcctggagaacttgatacgccttccacaagatttccatgatgtaatatagttatttgtgtatgtgggttgaggcttgggaccacatcttgatttgtttttctgttgtatgcacctagcataatgcctgttttatccaacacccttgaattttagaaactgatcatggtaaatatattgcatacttcttaacactgaagcagaaatctgcaatccaatacatgtctatatctatagagaaatttatggatactcgcactaagtgagcagttggcctggtctcttcctagcttgttgacaactggatgccaccatacaactgtattgtatgctcagacctggtggtggctgacaggagcattttgaagcattagccctcacttcttcag

SEQ ID NO: 49616 - DNA, 403 bp, Homo sapiens
ccaacagtgatggccaatttcttatcactagcttgtaactcttggaattaaatcatgtaactcttaaaatgtaattcatatatcacatatatgaaagtctgatgacaattatactcatgtacttgtatactatgtttcagctctggtctggctctgcttttttagacttgctgagaggtatggagccagtcttgtatcttactttttgagccaaggaagactttagagcaaggcctgctcatggttctcttctgcttggtcaacttgaaaaaaggctcagtaaagccaaggagaaagctggcatggggaattgccttggcaagcagtggtgactctgcaggcatgagagatagtgtgctttgccctgggaaataaagctattacctgttgattgctttgcttt

SEQ ID NO: 49617 - DNA, 1593 bp, Homo sapiens
ttctcttatgtgtttttaaattagcccttcatataaacttcaaattttaggtaggggagcttttatggttccctttatgccagtgaggaaacagccagagaggttgagtaacttgtccagggttatatggttaataagtggttaggattagtaactaggccagacccttctatggcctgtttttatctctaagatgatccccagtatgttagacttgaaactatggatggagtgaaaaatattctctgcaaatacatcaacactctgaaagccattgttttctctgtttagaaagtagttgaaaaagtagtgagaaactagagctttttcttttctggtgttagtttcagcttcctaccttgaagggaaccttaaggcccaaaccttcttttttacatttgaggattctaagtccatgcatctcggaaactatggagacgggaacttcttgtgtgagttggagagcagttgtagaccgttatcatttccatcggtgcggatgctctttgggtggtggtggcatagaagatctgttttggttacctttattgacaagctctactgtgtgactggcagttcagttcagcagataggtttccagcactaatcttaggcactgtgatagattcccgagatgcaaaactgaagaaaataccttgagacaagtcagtgccatctcagatataatttcctcagaaatcaagattttagagcatttgatgtttttaaattagagtcctttcaactaatagcctgtatgaagtttttaaaacacttataaaaaatttatggtgattattattattttgagacagggtcttgctctgttgcctagctggagtgcagtggtgcagtcgtagctcactgctgcctcaaacttctgggcccacacaatcctcctacttcagcctcctaagtagctgggactaaaggtgaatcccaacaccctgggctaacttaaaaaaatattttgtggagatagagtctcactacattgcccaggctggtcactgaactcccagcttccagtgatcctcccacctcagcctctcaaagttctgagattctaagtatgagctgccaaacctggcctatatgaagttttaaacatttgtagaaccagttgttaacattgcttttttttttttttaccataaaattggtatatgtcgaggaattctatcgtttgactatatttctattgtgttaaattttttgttttcttatatcaaaaatatttttgtaaatgtaaagaaaattcaagcagacagaagatggtgcaggtgctttctattatttaatagttcacctggccaggcacagtggctcatgcctgtaatcccggcactttgggaggctgaggcaggcacatcacctgaggtcgggagttcgagatcagcctgacaaatatggagaaactccgtctctactgaaaatacaaaattagccgggtgtggtggtgcatgcctgcgatcccagctactcgggaggccgaggcaggagaatcgcttgaacccgggaggcaaaggttgtagtgagctgagatcgcgccattgcactccagcctgggcaacaagagtgaaactccatctc

SEQ ID NO: 49618 - DNA, 362 bp, Homo sapiens
ttaattctatttaaagcttaggttaaaagggattgggttaatcatgtttcttactcctggaacattgtcaccaaactttttttgcagcactacaagacatacggatgcaggtgttcacgtgtgaatatgtgtatactgagttgtcttgaatccctattccatatttctatgcatctccccatataaggaaccactcaaatgtgtttgttccatatccttgatttttacgtatcttcgtgaaatagagagtattttatgtttatatgcttttaaaagttacataagtggtattatgctatagatctcttgctgtttcttactgtttactcagtagtgtgattttaagttttgtctacttgctc

SEQ ID NO: 49619 - DNA, 331 bp, Homo sapiens
ctgcacttttataaggaaggaaaattttctttatgcgggtatgaataatactaacaaatgaaatactggaacatgtaggtggaggatacatcattttggctgttacggatgatgtcaagtcatacctaacctgctcattgtataaaacttaattagtactccaaagtgccttactgtaactaataaaagatgtattgacccccctgtgctattaagataagactgagattctgtagcaaagagacatctcatgtcagaggtaagaggtcagaggtcagtgcttcgggctccagcagggttctgttccatgcagtcattcagggtcctaaag

SEQ ID NO: 49620 - DNA, 527 bp, Homo sapiens
ctatgtctccccctaaattcatgtgttgaggtcctaaccccagtatctcagaatataactgtatttggagataaggcctttgaaaaggtgattacagtaaaaggtcatatgagcaggacctaatccaagctgactggtgtccttataagaagaggagattagggcacagacacacactcagcggccatgtgaagacacagggaggaattggccatggataaaccaagggatagaccctcagaaaaaaccatcctgccaacactttgatctcatgcttctgccttccagaactgtgaggaactgaatttctcctgttcaagccacccctctggtgcccttgattatggcagtcctgggggattaacacaggcagaaggaaaatgaaggatgcaagagtcagagaaaggaagaaaatgaaatgtaatttctcctcaaacaattttcaaaataatggactttgggaaaacactttcaggaaattattctaaactgggtgtttgacgttttattctaaactgggtgtttag

SEQ ID NO: 49621 - DNA, 382 bp, Homo sapiens
gtgaaattaataaatactgtttaggaattttctcttttaggattataagtaacctggaaaataacaataactgaaatgctctgtaatttgtaagcagtcaacagatgtataagtatcatttcagttttcaaaattacattgtaaattgtttgaattggactttgaaacaatttttcttttaactataggtggtggatacattctagaaacttgcatcttaaagcaatcaaacaatttattttcagtatagattcaagactaaagcaatctccgaataggtattgtttcacttagatagctccaaagacaaaaactaggtcccatgaggctaaaacagtggtatgcataggggggtttatttttactatcctttaaactgtcc

SEQ ID NO: 49622 - DNA, 408 bp, Homo sapiens
  misc_feature (4)..(7): n is a, c, g, or t
  misc_feature (197)..(197): n is a, c, g, or t
atcnnnngcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactanagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgc

SEQ ID NO: 49623 - DNA, 274 bp, Homo sapiens
tggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtac

SEQ ID NO: 49624 - DNA, 477 bp, Homo sapiens
tttggtcagaaggtcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcagctcctaccccaagaggtcttctgacctttcctttccccgtgagtgtgaagctggcagaaatcactagtaaatgcttcagtttcctga

SEQ ID NO: 49625 - DNA, 544 bp, Homo sapiens
gtcctaatactagttttatgattaaaatattttaaaaaatcatatgttgtttgagtagataaaagttgaggaattagtttttcctagatactaaaatttcagtccacgaagaatcttagactattcttactttcctgccttcagttatacagtctcccccaaaatgtcaacaaggccagtttgctgtccgtgactgcaaggacatagcactcactgggcagaacgttcttgctaaggtacttgctctttccacctgaccattataagtgggtgacttcttatgccatcatttctctagagcttcctgcttacaagaaatggtgtcgcctccaaggttagcatggtgttaggtcgtctgaaattttattttgtactcagagagtatttcaatatttacagagcatacaagtagataatgtgatcttcccaagaagtcatcacattggaataaccttctgaaaatagaaatagtcctgatctcacaaaagcaacacactaataatttcatcattttgttgacttaattggtatctcaaacaatgtg

SEQ ID NO: 49626 - DNA, 313 bp, Homo sapiens
gacaatgaccttttttgaaaacagctgaaagagtgtggatttttctcttactttcaaagttgtccaatgataaacacaaaaacttaataagtttaaaaattattttgtttttctatcgtcttctatttggagagatatgtgctctgccatccaaacgtaaggggaatattatgttagatcctgtttgttgctgtatttaataagcttgctttagatttcgcatattattttctttttctctaaaacttttataaaactttccaggggagataaaatacatctagagtactgagtatgaaaaaaacttaaagtg

SEQ ID NO: 49627 - DNA, 172 bp, Homo sapiens
catagagagatctctggggactcactatgatcagatcttaagtgctactgaaaggacagtcctgatcctgccctcaaaacatctggtgacccgggaggcagagcttgcagtgagccgagatcccgccactgcactccagcctgggcgacagagcgagactccgtctcaaaaa

SEQ ID NO: 49628 - DNA, 545 bp, Homo sapiens
acttgtccatttccccagagatgtccaaaactcaagcttcaacagacattcctagagtaaaataaccaagatgtatgaatcccccttagaggattcagggccccattccatgtacaatgtgagagcaccccagacccagtcttgtccccaagagtaaaagactcagtttaatatattagcctacatgttggcaaagagaccaatacaaaaaggataatggagaaagtctttgcacagaaattttgcattctggcatctctatctgaattgtgattcttcataaaatgctggactgaaggattgcatagaggcaggccttgtgttaggtgataaacatgtttttatacagcaacacctacagccaatttccctatatgcaagcaaaatttccagtaagaattaatagttggctgggtgcaatagctcgggtgtgtattcttagcactttgggaggctgaggcaggtggatcatctgaggtcagaagttcgagatcaacctggccaacatggtgaaaccccatctatattaaaatgcaaaaaaaaaa

SEQ ID NO: 49629 - DNA, 497 bp, Homo sapiens
  misc_feature (484)..(485): n is a, c, g, or t
  misc_feature (493)..(493): n is a, c, g, or t
atggcttgaacccaggaggtggatgttgcagtgagccaagattgcgccactgtactccaggctgggtgacagaacgagactctgtcttaaaaaaaacaaaaacaaaacaaaacaaaacaaaaaattcaccttgcaataaattatcctgccacaaatgtttatgtttaattcattttgtatcctatccctttcccctcaacccccaaagaaatcatgagggatccagtttatagttgtgctgttagttgcttgaatcctaaatcttggagtacaaactgatcagggttcccaggtctacctggtgaagggcaacccaaggtgtctgtggggcccaaggaaagtctaggccctcattgttcaccagctgtatccacggagagcttgtcagacatgtggaatctcaagacccactaaagcttaagctgtatttctttcttttcttttcttttttccagcttgggcaacagtgtaagactccaataanntcaaaggngggg

SEQ ID NO: 49630 - DNA, 477 bp, Homo sapiens
atggcttgaacccaggaggtggatgttgcagtgagccaagattgcgccactgtactccaggctgggtgacagaacgagactctgtcttaaaaaaaacaaaaacaaaacaaaacaaaacaaaaaattcaccttgcaataaattatcctgccacaaatgtttatgtttaattcattttgtatcctatccctttcccctcaacccccaaagaaatcatgagggatccagtttatagttgtgctgttagttgcttgaatcctaaatcttggagtacaaactgatcagggttcccaggtctacctggtgaagggcaacccaaggtgtctgtggggcccaaggaaagtctaggccctcattgttcaccagctgtatccacggagagcttgtcagacatgtggaatctcaagacccactaaagcttaagctgtatttctttcttttcttttctttttttcctgttgccgaggttggagtgcagt

SEQ ID NO: 49631 - DNA, 152 bp, Homo sapiens
cctacctcaaaaatggggtggggtaagaggattgttccataggtgcccagcctgttctcccttctcccatgtttgagggaacccaatttttggcatcaaaggcctctagaagagtttaaatgtgtcctttcctaataaagagaagtactgga

SEQ ID NO: 49632 - DNA, 607 bp, Homo sapiens
gtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcatctggctcaagtt

SEQ ID NO: 49633 - DNA, 415 bp, Homo sapiens
aagagcggtagtaattgaacctttgttttgtctgtgctcaacttgcctacaggcccttaaacagggacttttcagtggtaggtcgcttcagaggctgtctctggtcttttagagtgcttaccttccacttccgtgtttaaaattgtcttttctgcttttgttggttagtttgtgttcaggatttttgcagtgcagatctctagctagcacggcataccagatttgaaaggaaacagatataattcacccctttatctctctcaaagagcaatcttcccaccactgaattctctgaaacctgcagttctgtgacacagaccatgtgctgccatgttgaacagcctttgtggtgtcctgtgtgtcacaagcctcagggaatagttttgagcctacagaggctaaaggatgtccccag

SEQ ID NO: 49634 - DNA, 210 bp, Homo sapiens
gaagaacttaacttcagctcacagtggagcaagaatatctaccatgaggcgaaagcaatcgcttgagggcattgcattggggtgagccagggcaggagctgcagagagcctgggacctaggaagagagcaggagaaaagacatgtggggatgaggtggagacagttgtgaaattgttcagtctcactctggaaagagaacacattcatag

SEQ ID NO: 49635 - DNA, 937 bp, Homo sapiens
atctcatgtaacctcaccttatcgcatatgaaagatcctctccagaaagcttatgaaagttaccccacgtcacagcaaggaagagtccaactctggtggcctgactcccagcaccactccttccttttccccacagcacacctgggcccacactgtgcctccttagggctctgaaatgctgggaacagagtggtgtgaggagggtggtcattctcaggccattttaagcaataactatttcaacagaactagtttaaagaggtttttaagcagggaagtgacctgaagtggaagtatgagtgggaaacttgcatggtcagcactggatttccaatgaagacctggaatccgttaggataggccagggaccaaggctgcaggctggcctctctgcccacaactctcctgaccttggaagcagggtacggaggcgtgtgtcctaaaataaagcatttgagctgctgctacagaggaacaatcaccagatattgtgaccctttcagatgcccagtagtcctgggaggcaggcagggcaggtgttattatcccttctttataaatgaggacacagaatgaggcagtacaagtgactctaaacacccccttagtgccacatcagtctcgccacctcccaggactaggtgtcacctgtattgacctcttcccctctgattataaaagtaatatatgttcattgtggaaagtttggaaaatgcagaaaataaaattaataatttaccccaaatcccaccatcctgagatcatcactgttaatgttttagtgtatttccttcctgtattttttctatgcatatataatttattttactacaagattgggatcatgctgtatttacagatttgtatcctgctttctttaacatattgtgagcattttcccatgtcaataaatattcttcaaaaagtaaaaaaaaaa

SEQ ID NO: 49636 - DNA, 806 bp, Homo sapiens
atctcatgtaacctcaccttatcgcatatgaaagatcctctccagaaagcttatgaaagttaccccacgtcacagcaaggaagagtccaactctggtggcctgactcccagcaccactccttccttttccccacagcacacctgggcccacactgtgcctccttagggctctgaaatgctgggaacagagtggtgtgaggagggtggtcattctcaggccattttaagcaataactatttcaacagaactagtttaaagaggtttttaagcagggaagtgacctgaagtggaagtatgagtgggaaacttgcatggtcagcactggatttccaatgaagacctggaatccgttaggataggccagggaccaaggctgcaggctggcctctctgcccacaactctcctgaccttggaagcagggtacggaggcgtgtgtcctaaaataaagcatttgagctgctgctacagaggaacaatcaccagatattgtgaccctttcagatgcccagtgtcacctgtattgacctcttcccctctgattataaaagtaatatatgttcattgtggaaagtttggaaaatgcagaaaataaaattaataatttaccccaaatcccaccatcctgagatcatcactgttaatgttttagtgtatttccttcctgtattttttctatgcatatataatttattttactacaagattgggatcatgctgtatttacagatttgtatcctgctttctttaacatattgtgagcattttcccatgtcaataaatattcttcaaaaagtaaaaaaaaaa

SEQ ID NO: 49637 - DNA, 273 bp, Homo sapiens
ctcagacacgcaggggagatatacaagtagacacactgcaaggggatgaaagcagtagtcaaagactttagagaagaaaggagaggcaaatggagtggctcctgagatgacccaggtgggctttcggaaggagaggtgttcaagccttgcccgcgtgggcctcagtcgtgaaaggaagggtggtcccagcagagggagctgctggcggaaaaggcagtgggcaaggaagagtccaaagggtttggaaggcagtatggcatcagagtgggttgg

SEQ ID NO: 49638 - DNA, 373 bp, Homo sapiens
atacataaacaaatggacatggccttgttccaggaggactttatttacatcgggctgcaggccggatttgaccagtcggccatggtttgcttacccctgctttagcttatggggggtgccccgcaagcacttgggaaattaatttgttgaagataggtgagtagaggcctctgatagtccagatcctcggttttagctctgtttacacaggaccaggttctgtgttcttgccactgagtcacagctgcaagaccctcgcctccccctagccccactcccccagctttgagtgatcccgggctccttcaagcccactgctgagtggggagcagtttctgtgccttccaggatctgtctcccctactgccactcc

SEQ ID NO: 49639 - DNA, 369 bp, Homo sapiens
ttatctgtttgattcagcatggggtcagcccctatctcagaagagggtggggtgccaagctgcagcaatgaggtaaaaaaaggctccaaaggaatattggggcacccttactggaaaaggcaaggaatgctgtgcaaacaaaaacaaacatttactataatcaacaagtaaaggaatttcacagacctgtaaatagggatactttggagatatagtcagagaaggctgttgctgcccttgaaatccctgcacttaggtagccatttttcttcacatgatgaatccttctgaaggaccccttcacaatgacagtctataagtcaaacgagacagaagggactctaggattctttcgctgcttttctctca

SEQ ID NO: 49640 - DNA, 324 bp, Homo sapiens
  misc_feature (183)..(183): n is a, c, g, or t
  misc_feature (189)..(189): n is a, c, g, or t
tataacttaaaagcctattttggtgcttgcttcggcagcacgtatactaaattggaacaatcaagagaagattagcatggcctctctgcacaaggatgacacgcaaatttgtgaagtgttccatattaaaagaaaaatttttgtccactgcgcccggcccctccctagttttattaattttcntgtttntaatgagacggagcttcgctccagcctgagtgacggagtgagactccatctcaaaaaaaaataaaaacttttaaggcctgttttgcctattctggataaaaatcttcctcagatgtagacgagacatttctgtgt

SEQ ID NO: 49641 - DNA, 889 bp, Homo sapiens
catcgctgaaggagagagaggattttatttctgggaaatggaatcggtttctgagtccagccaacagcagaagagaaagccagttatccacggactggaagatcaaaagagggtaagtggcagaactttgttggttgattggattatggtgctggaattgctaagtgtgattcagagagcataggtggtcatcatcgagcatgcttgtctgtctttctctccggaaggaggtagcatggtggcttgagatttgctatgtctcgatgctgggtgtcttgacttactggtaggcaagaagaaagataaagaaaagggaaaaaaaattcagtcctggcagccaaaaaggcaaagatttataagcgttaactgagggagttaacaaaaaatgttggtgttctcaaaatccaatatgagtttctttgtactgaagcccccttcgggattcacacactcttagcaccttctggaaatgttgctcctgaaagcggaggttttgtttgaattattctctgtgtggttgtctggctcttgtgtttatggatcaaaaacatattctactgcactctttggccctatctgtgagaatgtcacagccatttaaaatggcctgttgagtgtaggtcatttgctgtcattggtctgaaagctgcagtcacccaggacctgtgtctaccagttaaagttcaacttgtctttaaaaggcagacgcgttgtggagtagcatagggtggttggttgtctaggaagaaagttgaagctacatcttctcactcttggggcatagctaagaacggggcgtggcaagggttaaataaatctctagcagagtccaaatttttgttgaactgaaaataatttctgacatttcctttgaaatgttgtggatggt

SEQ ID NO: 49642 - DNA, 129 bp, Homo sapiens
ggacgctcattcacacttcaaatcacttgtcaaggactctaccacactgtaccactgtacactctggaatgtgattagttctgtgtcccccagacactggcacagtaaatgctcaatgccgcttgctaa

SEQ ID NO: 49643 - DNA, 885 bp, Homo sapiens
aggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggt

SEQ ID NO: 49644 - DNA, 397 bp, Homo sapiens
ccttgctcccttttgaaatgatgaaaatgacagtaaattagggattttaaagaggcaaaaataaataaaatgagataagatatattttcaggaattttttctaagctatgaaacagatggacaaaaggtaacagataagtagatctgaggaaactgaatgctacaccagcaatagggagaaagctaagaactgaccctatttatattgtggagcagaggccctgggattgggaccatcaggtatctgacagagtaaaggctgaaaacaatgagtggttgagaatctgtttaagaagcagttggaatccctgattccttcttatataactaagctaatgattcttccttttctactttaggagaaaactataatttttaacccctccacccccaacgg

SEQ ID NO: 49645 - DNA, 411 bp, Homo sapiens
ctccactgcactccagtctaggtggcagaatgagatcctgtaacaaaaaaaaaaaattacaaacataaaatttgttaatgtatttgtttagttgtcccaatattatttattaaataaaccatctttctaatacatttgaaaggcttgctctttgacatatatgaaggtcaaatcacggcaatcctgggtcacagtggagctggcaaatcttcactgctaaatattcttaatggattgtctgttccaacagaaggatcagttaccatctataataaaaatctctctgaaatgcaagacttggaggaaatcagaaagataactggcgtctgtcctcaattcaatgttcaatttgacatactcaccgtgaaggaaaacctcagcctgtttgctaaaataaaagggattcatcta

SEQ ID NO: 49646 - DNA, 645 bp, Homo sapiens
cattctggtctgataatttttgctttgatgtagttcaaattatcaatctttttctgcatggtttctagattttgcatattttctggatgtatacatacatgacattagcaaggctttatatctcaaatgcataattaacaagtgaaataccctagtttcttttctcccctgtaacctggaatcagataatagtgttgctatactgagttcacattggcttatgctgacctagacttcagataggcaactgtctttgattaataaaacatggaagacaaaaattattatgtgtaaatgcaatttggtagggaagaatttcaaagcatggaggagggaggaagtatatattaaaaaaggaatcttggtcaggtatggtggtgcacgcctgtaatcccagaacttatggaggccaaggcgggtggatcaattgagctctggagttcaagacaagcctaggcaacatggcaaaaccccatctttacaaaaaatacaaacattagccaggcatggtggcatgtgcctgtagtcccagctattcggaggctggggagagaagatcacttaagcccaggaggttgaggctgcagtgagctgtgattgcatcactgcactccagcctgggtgatagagtgagaccctgtctcc

SEQ ID NO: 49647 - DNA, 601 bp, Homo sapiens
caattctcagtcctcatcttaattgacttatctggctggagtttgacacaccttcctccttctaacactttttcatttgcctaatagtcaccctttatcttggtatttctcttcttagtagccactcttcattctgtctttctgatgtctggtgcctcctcatatctgtaacctctaaacattgaagtaatccagaactcactccttgtccattttctcctttttactattcactcccaaggtcactgtttcttaatgtgtagaagacgactctggtagatggtcaaataacttttctctggcgtaaaactttgggatcatcatcttacacatttcacattaaatccctcagcaaattgtgtcagctcttgtgtcaggtatctagtgatatgtgagaaaacacagagattaatggctaaaaaacaccactcatgtatttgtttacaattctgcagattggatagggcttggcaggaacaacttgtctttgctgtactaggccacaaaatccactgttaggttggctgacacatatggtgggcaagttggctcttagctgggaactcagctgggactgttagccaggtgcttaattatccag

SEQ ID NO: 49648 - DNA, 1542 bp, Homo sapiens
gccgttctccaggtgaccttggactgacccacttctccccacttctcactagttgtcaaaaagaacagccttgctatctggtcaggtgaatgacaaccaagtggaaaaagatctgtgtggttacaaggagtatggcaaaaggttgctaactggcaaggacaaatacatgtcacctgtggatgctgggaataccatagccaccttttagggaaacttaaattatgtttttggataccctgtaaaactttgctctgacaaggaacctcctttactgcccaaggaacatgacagcaggcacactcatggaatacaatgggttttccatgcaccctgtcatcctcagtccaatagagctgttgaacaatggaaagccagctcacaatgagtgaaggaaggacaccaagatagcctacaagtggggtggtaccaccccatccgaatacggcagtatggacactgagcactgccctccagggcaagggaaccacatgattgcagcacatgttgagaagcactgagcttggaggaggtacaggtggaccagatgacggctctgcctgtgaaatccaaattccagtgttcccagccattttctctttttagagtgcacatcctgtgggtggtttgcagttcaggctgccacagtaccccaaaaggcccccctaactcttaatctggagtcagcgtttccctcaggtgcactccctgtgggatccctcaagggtggaaacaggaccaagaaataccaggatgctagagtccctctgatagtgccagggacatctgatccttccatttggctgggcaatgttgtcagacatgtcatcattcaagaagtgacttcccttcctggactggatggctgaggctgaaatgtctgaggcatttcaagggtagtaccacaggatatggtaatgtttatagtatacagtgtgatgttttgatatttgtatatgttatggaatgattacctcaatcaagctaattaacatatcatctcacataattaccttttttgtgtgtatggtgagaacattaagatgtattctggcaaattttaaatatataacagtattagctatagtcaccatgctgtacagcagatctccagaacttattcatcatgcataactatgactttgtattctttgataaacatctccccacttcccctgctccccagcccttggcaaccacattctactccctggttctatgcgtttgactttttcagattttacaaatgagtgagatcattagagtatttgtctttctgtgcctctttgatttcgcttagcattatcccttctatgttaatacatgtcacaaataacatgtcctttttaacgctaaataatactcctgtgtgtatctttatatctaggttgactctagtttttttgctagtatgaataccgtaaacatttgtgtacaggtcacagacatctgatccttccattgtggtgggcgatgttatcagataggtcaagtttgtttaggacctgacctcccttcctggactagaccactgaggccaaaagg

SEQ ID NO: 49649 - DNA, 1352 bp, Homo sapiens
gccgttctccaggtgaccttggactgacccacttctccccacttctcactagttgtcaaaaagaacagccttgctatctggtcaggtgaatgacaaccaagtggaaaaagatctgtgtggttacaaggagtatggcaaaaggttgctaactggcaaggacaaatacatgtcacctgtggatgctgggaataccatagccaccttttagggaaacttaaattatgtttttggataccctgtaaaactttgctctgacaaggaacctcctttactgcccaaggaacatgacagcaggcacactcatggaatacaatgggttttccatgcaccctgtcatcctcagtccaatagagctgttgaacaatggaaagccagctcacaatgagtgaaggaaggacaccaagatagcctacaagtggggtggtaccaccccatccgaatacggcagtatggacactgagcactgccctccagggcaagggaaccacatgattgcagcacatgttgagaagcactgagcttggaggaggtacaggtggaccagatgacggctctgcctgtgaaatccaaattccagtgttcccagccattttctctttttagagtgcacatcctgtgggtggtttgcagttcaggctgccacagtaccccaaaaggcccccctaactcttaatctggagtcagcgtttccctcaggtgcactccctgtgggatccctcaagggtggaaacaggaccaagaaataccaggatgctagagtccctctgatagtgccagggacatctgatccttccatttggctgggcaatgttgtcagacatgtcatcattcaagaagtgacttcccttcctggactggatggctgaggctgaaatgtctgaggcatttcaagggtagtaccacaggatatggtaatgtttatagtatacagtgtgatgttttgatatttgtatatgttatggaatgattacctcaatcaagctaattaacatatcatctcacataattaccttttttgtgtgtatggtgagaacattaagatgtattctggcaaattttaaatatataacagtattagctatagtcaccatgctgtacagcagatctccagaacttattcatcatgcataactatgactttgtattctttgataaacatctccccacttcccctgctccccagcccttggcaaccacattctactccctggttctatgcgtttgactttttcagattttacaaatgagtgagatcattagagtatttgtctttctgtgcctctttgatttcgcttagcattatcccttctatgttaatacatgtcacaaataacatgtcctttttaacgcta

SEQ ID NO: 49650 - DNA, 346 bp, Homo sapiens
aaaacaaaaataaaattaattttcttcaagaatgaagaattgaaagtataaccaagggaatgtattcacaatgtagcatcatataacagaggaagcaggcaagactttcctagtatgttaattcaaaatggtcttacattaacacgggaacaaaggcccagagaggttaagtgattggtcaaagatacccagtgagttaggggtactcctgggctaaactcaaatgctaaactcttggctgagcactctttccaccacctatggtgccagctttatgcagcagctatgaaatctcaataaattttagtcactgacattcttttccaactcgattgataaatacaga

SEQ ID NO: 49651 - DNA, 409 bp, Homo sapiens
tcttacaataaacctgttttacagctttcattttacacataagaaaaactgaagcagagagaggttaagtaacatttccaaagttatacaactagtaagttgggattcaaacccgggaggtctgctgtgagtccttgcattaaagacaatgcttgccaagtaataagttctcaaaaaatggatgatgatgatgatgataagaaaatagcctggcatatagtaggtactccatataagccatgctgccctcttctgtggctagccctaatcctaaacatctatcccctccccgcagtaagcacattttctttttccttctcacctcttttctggccatttgggtgctctgagcaagccagacagaggcttggctggatgcggaaagaccaaatgtggtgttgcaggtgaa

SEQ ID NO: 49652 - DNA, 588 bp, Homo sapiens
ggaaaatcttggttcttataagatgcgttttatatagatacagaaatttgtgtgcttttgaattgattttccagttagctaatgtttattctggttctgcttttttcccccttttttaatgttttaatctgcctacatttgaaaatttccattttgagagtgttcatgaaaacttccgtgtttctaagtgttgataaatataaattagtacagtaaaactttggaattttaatcagtttcagttaacaggacaggtgttctgtggcctgacgttttggggggacaacacggagtataaatgtcagctttttctttttttaataaatgtcagcttttttttaacagaaaatttcccagatggttatctgaatccccaaattacctgtcctagttgtaaatcaatgccataacgtcattctgcttctaaaataagaggcttaaacctaaattctatccatgatgtggtttgagataccatttcaaaagcaccaaccctatgctaattactttactgccaacatcattctttcaggtccactcccctccctccagtagtagtgatggtttgagttaatgaccagatcttta

SEQ ID NO: 49653 - DNA, 278 bp, Homo sapiens
gacgacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggcca

SEQ ID NO: 49654 - DNA, 715 bp, Homo sapiens
ggtggaatctgcagattcagaacccatgaatacggagtgctgactgtatatactattgaaaaaaatcagatactatagaagagtacgaagaagaaggcaaaaatgtccctagccgggttaccacccacagataacttgtctgatatattttagtgaccatctttagcatgtttttacacacctgcgtgcatacgcattcccccattccctctcaggcataaggaaactattttacataaatagcaatttagtttcattgctgttctctagcttatcttttatttttactgaatcagtagtataggtgtctcttttcatgtttaataaaaatatatcaactcataatttttaatagttatacattatgatatgttccacagtccacatgaccaaatccctactggtagatattttacttatttctttttttaaaatactataataaaaaagtgctgtgctaaccttatctacttgtgtcatttttcttcttagctttaattcctagatgtgagtttgctagatcaagggcatgcttattctttgcttattcttctcccgtctcctcccgtttttctccttcctgcctgcctgcctgcctgcctttctttttcttttccccttctccttccctttttcctttctccttttaccactctggagtgcggtggcatgatcacagctcactgtagccttgatcttctgggctcaagtcatc

SEQ ID NO: 49655 - DNA, 736 bp, Homo sapiens
agcaaagttttaaatgagtagaagtgtacaatccccattttgcagaagagaaaactgaggtgcacagaggttaagtaacttgccagacgtggcaggtctgataagagatgagattcacatcccttccacccacccccaaattaagcactattttagatttttttttttaaccttactcattcttgagcatatgatcatgaaaaaaggtacaatgtgacataagtagacagctgttgctactagcttctttcctaatctctctctttggaaagtgggggagctgaggatttttattttaatataatttctagcccatttcgagacatagttttacccactagatgtagcatcttttgatgataaggatgatgatgattgtttaaatcaattattgtcacgatggtggcaaagtggcaaggtctaactccatcctacatttattagtctgtattctactcagaaaaactgcactctttccatcatctccattgatgaaagaaaaacttcagctaaattaaatgtaaaggagtttaattgagcaatgaacggttcgccaatcgggcagctcccagaatcacagtggattcacagagactccagcgcagccacgtggtggaagaagatttatagaggaaaaaagggaaatgacttacagaaatcagaagtgaggtacagaacagctggattggttacagcttggcatttgccttacacagtttgaacactcagcaatgta

SEQ ID NO: 49656 - DNA, 1687 bp, Homo sapiens
agaatctagaaccatggctgaccaaagcgagacttccgagtaaggttcgttaacaggcatcctgctgaattagaaggaaacaggaacgaatccaaagcaaacggggctaaacttccctcgaggacatttcctgagctgcaacatgggaagcgacacaccgaagctggtgagctggtgcaactgcacacaccttttctctggtttttagtactcgggtcatcctggggagaccgctcatgggctatgggcagcccatgcctggattttttggtgaatgagtctgaaaagcagtgaccaggtgtgttgagggcctccccttgcctgcacctttttatctctgagtgactgagggctgccaaggccagacaacgcacatgtgtcctggatcctcccctggcctggggcagcagcagcagcagcagctgggcttggggtgagtaggctggcttgaggaaggggctgcccacaagcagggctcatttcctgggtcagggcctgtcagactcaaagtcagctcttcagcattctgtttagaaaatgatgatgcagttcagtgagaaagaaagctcaggataaaatatgttttctggaggggaaatactcaagtgttctaagccaggaacagagactctcaagagaggaattctctggcattctctgccttggataaatcatggattaaacatgagcatccttagaataattttatttttgtatttcactttacactgtaatgcaaacagcttttatgttttctttgacgaagaatcataattgagtcactttaggtcttttagctggaagcatttcaccctaaatgaaaagttaatgcattttttacaaggattaacatgctaactacaacttgccctttcagcagatgacaataagggattctgaaaagtttggactgtctttttctttttgtatacaaataaagcagcagatcctttctctgtgaaggttgttgcagagctcccgtaccagcttataaaatgcggctgtttaagcaggacttgggtgggcagcagaattctgcacatgacgagtggctgcagcttagaaagcaaatttcacctgattccagtactgtgattttaaggaaacggtaaaactcaaagtgccagtaatgccatcaaggctcagtaacatgccatttcctcagcagctaaagacaaaaagaattattttggtgaggggatagaaatcctttcgctttgcagtgacacccactttttcttagcttggcttgggagtaaggagattggagtgtggggggacattagaaactcatttaaggcaaactgaaatctccttcatcagcagtcttcctgctggtgtagccacagcagaactccgaggcttgcaggctgggctgtctccttgctgcctggcctgggtgtttatttgggcaatgcaagctgacattgtgaggtgttgccgatgcccaggccagctagcagggagccctcccagggctggtagaaacctatgtgtatatatattctcaaatttaaatagattgtacatagtgaaatgtaaatgacatgtaaaacagcaatctctatttttcttaactattatatagcagtatatatttgttgaacatgcttgtatactcttcattaaccattttaatattttgtacagataagttgattaaatattttattcataaaaccgctca

SEQ ID NO: 49657 - DNA, 936 bp, Homo sapiens
  misc_feature (1)..(3): n is a, c, g, or t
nnngaggagctgaagggaccagcttggccgtcagttgcaagggtgtgaggcagaagcaacacaaaagatcttgatatgaagcaattatttttggtcttaaactgctgggactccagatgacccagaccacggtcagcaggcagaagccagatgctattgtcaacagaattgccttcaagattccttttctgattgttcattgctgagatgacatctcactatattgcccaggctggtcttgaacttctagcctcaagcaatcctcccacctcagcctctgaacgtactggaattacagatggagcaactgagattcttccccaactagactataagttctctgagggataaggaacatgtctggtttcctcatctctctgtcacagcaccctgtgaatgcctagaagacagtaagaatcaactgaatgtttgtagaaagaataacgatacttacctatagtctaaaggtttagtgatgaaatgaagtccactaacttctctctgcttacttccaccctcaataacatatttcctcaaaccccacagaggaaagacaattcattttttactattgtttaatagagccatgtttgtatgtagcttcctgttccgcttagcccaagacattaagtgggtcaggagtaaactctgccctctgtttttttccattcctttgtcacctgctcaagtggcagcccagagccgcttggcggcttccctgaagatgagcagagtgcagtagattaggcatggcctttctatctatttctactatggagaagctgaaaaagctatatggctggaaaaaaatcaccttggtactaatttgctattttacaatatttgaaaataaagacctgtggtcttcctatgtatttctttttaaacaatgaggggtatggaacatctatgaataaacatcaaggtcttcaagtg

SEQ ID NO: 49658 - DNA, 1403 bp, Homo sapiens
  misc_feature (1)..(3): n is a, c, g, or t
  misc_feature (1402)..(1402): n is a, c, g, or t
nnngaggagctgaagggaccagcttggccgtcagttgcaagggtgtgaggcagaagcaacacaaaagatcttgatatgaagcaattatttttggtcttaaactgctgggactccagatgacccagaccacggtcagcaggcagaagccagagatgacatctcactatattgcccaggctggtcttgaacttctagcctcaagcaatcctcccacctcagcctctgaacgtactggaattacagatggagcaactgagattcttccccaactagactataagttctctgagggataaggaacatgtctggtttcctcatctctctgtcacagcaccctgtgaatgcctagaagacaaatgaaatgggtcagcatctgacatactgcataaatcactgaaccaatattttctaaatgtaacatgcatgatggtacaaaatcacacatagatgaaaatcaactggtctttgaagaactttgattcattagtgagcttgaaaacccaacacaataaacagatagtggaagtggaaggagtatccctaaggatgcatttaaggagaaatgatgtgacagaagatttgaaagcaaaaaagaatctatcaggaagataagaaagcaattattaaacaaaaattaagaagccaatcgccctcccaagtttctaccccttggtaacattactgattcacactagtcaaaagtgctgaataatttgctacatgccattggaaaactatataacttactactaataaaacacctcacttctttttactgtctttcttcatttacccaagtcacctcttttaagaggcatctttgatttgcctacaacacattcatctacactgattgcttgtacaagaaaacaatgcaacccagcaatgtcagagactgaaaggttgtcttcttgctgtgtaagatttactgtgaatagagggaggatgtggaaaaacgctacaaccattgctccagggactatctctgccaaacagagatattatactgacgaaatgataatggtgaaatagctgtcagaccaaataattagaatatggagccgtaatacagtaaagtagtcttcatatattttatacagtttgtattgttctataggttgcttggagtttgtgtccagtgaaaatggatttagaacaacctgggatacttagtaataacaacgcacaaacatgtgtatacacaccaaagaagtgtgcattattcaataaatgtgttcctgatatgttgcatgtaaactgattttgtatggtcaaataatatcttaaatgatcaaggaattgattaaagaaatatgagatattagttacaaaaggaaatcattttgaaatacacgtgaaattttaaatcatgtttcatcaataaatatgattattacttttnt

SEQ ID NO: 49659 - DNA, 881 bp, Homo sapiens
  misc_feature (1)..(3): n is a, c, g, or t
nnngaggagctgaagggaccagcttggccgtcagttgcaagggtgtgaggcagaagcaacacaaaagatcttgatatgaagcaattatttttggtcttaaactgctgggactccagatgacccagaccacggtcagcaggcagaagccagagatgacatctcactatattgcccaggctggtcttgaacttctagcctcaagcaatcctcccacctcagcctctgaacgtactggaattacagatggagcaactgagattcttccccaactagactataagttctctgagggataaggaacatgtctggtttcctcatctctctgtcacagcaccctgtgaatgcctagaagacagtaagaatcaactgaatgtttgtagaaagaataacgatacttacctatagtctaaaggtttagtgatgaaatgaagtccactaacttctctctgcttacttccaccctcaataacatatttcctcaaaccccacagaggaaagacaattcattttttactattgtttaatagagccatgtttgtatgtagcttcctgttccgcttagcccaagacattaagtgggtcaggagtaaactctgccctctgtttttttccattcctttgtcacctgctcaagtggcagcccagagccgcttggcggcttccctgaagatgagcagagtgcagtagattaggcatggcctttctatctatttctactatggagaagctgaaaaagctatatggctggaaaaaaatcaccttggtactaatttgctattttacaatatttgaaaataaagacctgtggtcttcctatgtatttctttttaaacaatgaggggtatggaacatctatgaataaacatcaaggtcttcaagtg

SEQ ID NO: 49660 - DNA, 1102 bp, Homo sapiens
  misc_feature (1)..(3): n is a, c, g, or t
nnngaggagctgaagggaccagcttggccgtcagttgcaagggtgtgaggcagaagcaacacaaaagatcttgatatgaagcaattatttttggtcttaaactgctgggactccagatgacccagaccacggtcagcaggcagaagccagatgctattgtcaacagaattgccttcaagattccttttctgattgttcattgctgagacatggtcttgctctgtcacctaggccgtaatacagtggcgtgatcctagctcacagcagcctccaactcctgggctcaagagatcctcctgcctcagccttctgactagctgggactacaggaatgtgctaccacacccagctaattttttaattttttgcagagatgacatctcactatattgcccaggctggtcttgaacttctagcctcaagcaatcctcccacctcagcctctgaacgtactggaattacagatggagcaactgagattcttccccaactagactataagttctctgagggataaggaacatgtctggtttcctcatctctctgtcacagcaccctgtgaatgcctagaagacagtaagaatcaactgaatgtttgtagaaagaataacgatacttacctatagtctaaaggtttagtgatgaaatgaagtccactaacttctctctgcttacttccaccctcaataacatatttcctcaaaccccacagaggaaagacaattcattttttactattgtttaatagagccatgtttgtatgtagcttcctgttccgcttagcccaagacattaagtgggtcaggagtaaactctgccctctgtttttttccattcctttgtcacctgctcaagtggcagcccagagccgcttggcggcttccctgaagatgagcagagtgcagtagattaggcatggcctttctatctatttctactatggagaagctgaaaaagctatatggctggaaaaaaatcaccttggtactaatttgctattttacaatatttgaaaataaagacctgtggtcttcctatgtatttctttttaaacaatgaggggtatggaacatctatgaataaacatcaaggtcttcaagtg

SEQ ID NO: 49661 - DNA, 1003 bp, Homo sapiens
ccgagatcatgccactgcactccagcccgggcgacagagcagattccgtctcaaaataaacaaacaaacaaacaaaccaaacatccagatttcttgaccaaaccagtgccttctgcaatcttttgtatctcagtaaatggcagtttgccaggctgtattagtcagggtcggggttctctagagggacagaactaataggatacatgtatatatgaaagggagtttattgaggagaattgactcacacgatcacaagctaaagtcccatgattggctgtctgcaagctgaggtgcaaggaagccagtggtggatcagtccaagtcccaaaacctcaaaaatagggaagccgacagtgtagccttccatctgtgggcaaaggcccaagaggccctggcaaaccactggtgtaagtctaagagtccgaaagctgaagaactgggaggctgatgttcaagggcaggaagcatccagtacggcagaaagatgaaggccagaagactcagcaagtctgctttattctagccgctctggtagccgattagatggggcccacccagattgagggtgggtcagcctcttccggtccactgactcaaatgttaatctcctttgggaacaccctcacgacacacctaggaacaatactgtgaatccttcaatcaagttgacacttaatattaaacatcacaccagggccaaaccttgggagtcctgcctgacttctcacacccacatttgatccatcagcaagtcctacaggctctactgtcaagagcatccagaatctgcttttgctactcccactgcctcacccccgaatcctggccacctcctggaccagcccgcctcacctctctcctgccttttgcagctacctccccttcctgcttctatgcttgtctccctgtgttgtcttttctcaacacagctgctagagcaatcctattaaaatgtaaacaaacaaaaccaaaaataaatgacaattctcctttaaaaaaacca

SEQ ID NO: 49662 - DNA, 985 bp, Homo sapiens
ccgagatcatgccactgcactccagcccgggcgacagagcagattccgtctcaaaataaacaaacaaacaaacaaaccaaacatccagatttcttgaccaaaccagtgccttctgcaatcttttgtatctcagtaaatggcagtttgccaggctgtattagtcagggtcggggttctctagagggacagaactaataggatacatgtatatatgaaagggagtttattgaggagaattgactcacacgatcacaagctaaagtcccatgattggctgtctgcaagctgaggtgcaaggaagccagtggtggatcagtccaagtcccaaaacctcaaaaatagggaagccgacagtgtagccttccatctgtgggcaaaggcccaagaggccctggcaaaccactggtgtaagtctaagagtccgaaagctgaagaactgggaggctgatgttcaagggcaggaagcatccagtacggcagaaagatgaaggccagaagactcagcaagtctgctttattctagccgctctggtagccgattagatggggcccacccagattgagggtgggtcagcctcttccggtccactgactcaaatgttaatctcctttgggaacaccctcacgacacacctaggaacaatactgtgaatccttcaatcaagttgacacttaatattaaacatcacaccagggccaaaccttgggagtcctgcctgacttctcacacccacatttgatccatcagcaagtcctacaggctctactgtcaagagcatccagaatctgcttttgctactcccactgcctcacccccgaatcctggccacctcctggaccagcccgcctcacctctctcctgccttttgcagctacctccccttcctgcttctatgcttgtctccctgtgttgtcttttctcaatccaccttctaaggatatccagttggaatgtaatctttctttaccaatggtttatggatag

SEQ ID NO: 49663 - DNA, 316 bp, Homo sapiens
  misc_feature (146)..(146): n is a, c, g, or t
tcagtgaataatagaaaacttttattagcagcatcttaaaaagtagggaaacaaacacccagtctcttgataaaaatgagtctcttgggccaggcgtggtggctcatgcttgtaatcccagcactttcagaggcccaggtggcagnatcacaaggtcaggagttcaagaccagcctggccaaatggtgagaccacgcccccccccccccatctctactaaaaatacaaaaattagccgggtgtctgttgtcccagctacttgggaggctgaggcaggagaattgcttgaacctgggaggcggaggttgtagtgagc

SEQ ID NO: 49664 - DNA, 443 bp, Homo sapiens
cctctggctgcccttctgaaggatcccgtgaggccaggcagaaatggtttgctaggggacccagcgagctcacaagtctttcctcattgcttcctctgcccctgtattttgctaggctctctaaattgactcggcttcaggtatcaagacgctcaccttctaagaggcttgccctaactggagtgctggagtctgaactttctttgaacatcgtttgatctcagatgcagccagtcctgtgcacagcctgatgggatggaatgttcaggatcatcatgtgattcccctgggtggcctagctgagggacacaaatttccccaggcagagaagacagcacaggaggaagaagctccaatatcgagagtgagagggctgcaaattcgtcaagagctggcacctccaaccaaaaatgtgcagttatcgatcaataaaaccagctttt

SEQ ID NO: 49665 - DNA, 940 bp, Homo sapiens
tctggttggctctctgcaaggctgctttaaagcaacactgcagtgctagcagtggaggccctgctgatcagtgattcatcccagggattctgaggggccatccatatcaggcaggtggcccaccctgcccactgatccctctcaccctgctcagcaggtcctcccctgccaccgagcgcaaacatctgtgtccttcaatgacctgcccaactctgtttggtttcctgcggagagagggctttttaactttctgcttcctgcctcgccctgcttccctggttggcccaccggagtgacctctgatcctctagtctcagttgagccaaattctgactgtggactgttgtctgggttctagctttctttcaaaccgcgtgacagtaggggtttgggttggctctagacacggtgagcgcctagtcattgtcatgagactggatcatttcagcctgggggtctgccagcagttgtgtgttttgctgggatagactcagacagctcccttgagacattcccaggcaatgggaagcctaggaggcctgcaggactcagtttacatgcaatctcctactgactccacacctggggttcattttggaggctctaggtcaagaaaccctctggctgcttccctctttttccctgtgggagcttcatagggtagatgtggaggccacagtgtatatggggaccaggaagctcagaaatagagggaggctgatgatgggggagcagaattgagtgtggcatggaggctgccaggggagctgttacaggtctgcttgcatcagagtggactaggttgacgagaaggattagtaaagaggagctgggacttgaagctaagatttaagaaaaaggatctccaggacacttcatctggaggcccagagaaggcaaaatcttccagtcaaagcaacttagctgaggaacaattttt

SEQ ID NO: 49666 - DNA, 145 bp, Homo sapiens
gaaacaaagttcctgattgagagaccagaggaggccacttgggatttgatctcagaagggagtctgctcatacagagatgcatatgaagacgttccagaaagagggaacagagttggcagagcttcagctgcagagagggagcag

SEQ ID NO: 49667 - DNA, 397 bp, Homo sapiens
aggggaggcacagactctgcatgggcataaccccatgatgcagggaaacccacacctggtggaaggggatggctagaggaggctcggagtgaagccccctgaagctcaggacctggagcttggcattttgtgcctgggtataagagagacaataccgttaggtgaaattttccaattcttacaagaaacccttccctaatcgtgttcacatggtttgacatttttaaatgcttttgacatttggcttttgcaaatattaataacagtttagctgatagaaatataaactgaacgttagttgtataaaaattatatgctctcaaaatatatttagcaacttcaaaagatttagctgcccatctgttttgtagaattaacaccagcttgaaacatattc

SEQ ID NO: 49668 - DNA, 644 bp, Homo sapiens
gcaggttttattcctggccaggaatggaaaaggagagagctcttgctctaaagacaccttcctcccaagctgtgggaagctggggaactttaaggagttagatgttgggtggaagataggtaagcatattcagagaggaactccagatgtactggcatacatcataaacgtgtctccatacaccccacgttcagaaaaggcagcgattctcctctgggtgagaagcttagcattataatgatatgctaatgatctaaaggtagcaaggagtctctgcttctggtttgctgagtttcactcaggccttatcttcctgtagtaattggcgaagggtcctgaaactcctggaccacaaggagtccttttaagcaggcttaaaaggactttaagtaaaagagaatagaaaaaaagaaagctgtttaagaaaataatgagcttcctcagctgtatctcctggaccgccctggtaacagaattaggaaaataaatagcagtggcaaagtagaggtacttttctcctttattgtcatgaattactaaatgaatcagaactaacagagctggcatgaataggaactttaacattggacaaagagaaattcaagcataagccatatcaatatcaaaaatttccttagatgtat

SEQ ID NO: 49669 - DNA, 422 bp, Homo sapiens
aaccagtctggcaaagtagaaaaagcaaaggatttagaagtcaaaacacctgcttttaaaaggtcctgatggccagcagccatttgacctcaagccacaacctctctgggtcttatcttactcatctgtaaaatggttataataatacaggacagagttgctgtaaaggctcaaacaagctaaggcactttctaaactatgcagtttatagagtttataggcttcaaatgatgactactacaatgcttagtatctcgtaataaatatgtttctccttctccaatgatcagatctacccagaaagcctacttcaggtcttgaataaatatatatatagtcttggcccggcgcggtggctcacgcctgtaatcccagcactctgggaggccgaggtgggcagatcccgaggtcaggagatggag

SEQ ID NO: 49670 - DNA, 618 bp, Homo sapiens
gagaatcgcttgaacctaggaggcggaggttgcggtgagccaagattgcgccattgcactccagcctgggcaacaagaacgaaactccatctcaaaaaaaagaaaggagaagtgagatcattgttttgtcaagtatataccgggtattaaaatttaaaaagttttctacttaattggttagatcttgtcaaacttattgtttttatactctaccttcagaatatcttagaggtctttagctcaacctcaggtaaaatatgaattaatgacattttatagaatatgaattaatgagatttcactgactgtgtgaaaataaaagtgaaacctggccaggtgtggtggctaatgcctgtaatcccagcactttgggaggccgaggtgggcggatcacctgaggtcaggagttcgagaccagcttgaccaacatgctgaaactcggcctctacgaaaaataccaaaaaaattagttgggtgtggtggcgggtgcctgtaatcctagctacttgggaggctgagatgggaggatcgcttgaacccaggaggcagaggttgcggtgagccgagatcgcgccgttgcacttcagttgggcgacagagcgagcctccgtctcaaat

SEQ ID NO: 49671 - DNA, 390 bp, Homo sapiens
gagaatcgcttgaacctaggaggcggaggttgcggtgagccaagattgcgccattgcactccagcctgggcaacaagaacgaaactccatctcaaaaaaaagaaaggagaagtgagatcattgttttgtcaagtatataccgggtattaaaatttaaaaagttttctacttaattggttagatcttgtcaaacttattgtttttatactctaccttcagaatatcttagaggtctttagctcaacctcaggtaaaatatgaattaatgacattttatagaatatgaattaatgagatttcactgactgtgtgaaaataaaagctgaggcgggcagatcacttgaggtcaggagttcgagaccagcctgaccaacatggcgaaaccctgtc

SEQ ID NO: 49672 - DNA, 601 bp, Homo sapiens
ggcacttaatgtgggtatctaaaagccaacaggaaggatccgtcgaggcaggtgggggttgaaaaaaatcattaagagagcaagaaaggatgattggaaatgccaggatccagaaagaacagaagagccaagctcaggtagaggggctggctcttcagtaccaggaagatggcaggatggaatgagtgtgtgtgcagctagatcgtgcagggacgtgaaggtatttctctccaaaggcttctgtttcccccatcgagtaggagacaaggccatctgctgaaagggacccagaggtaggggactggactctggggcaacttgaaaaggtttgaagaagtctcttaagcctcagtttcctgggtaaaataacagtatctgtgtcatacagttctgaggattaaaagagctaatacttgtccagaattagccttcgagcctcacgcataacaggtgcacaacggatgctcatggttacatgccccacggagtcatcagctgccaacactgagggcagatgctacttgcccgtggttagccttttaagtgccttgattcctcatccaatagcctgttttggtaccatagaacaaattataaaaag

SEQ ID NO: 49673 - DNA, 249 bp, Homo sapiens
gacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggcgtgaccttctttgaggtcagccctctgtgcaatttcaacatcatagagtctttcacggagctggccaggatagtgctgctgcgg

SEQ ID NO: 49674 - DNA, 207 bp, Homo sapiens
tttcccccctcacccccgcaagcagaagagaaaggatcccagatggaagcttggagttgcaagatattaggaaagcatgtagaagtaaatctgaatcaattatgcaattatgtctatgtaaagcagtaataacaatgtctattggggcttatgatagagagaaaattaaaatttgtgaacaatagcacataaagtatgaaagatggg

SEQ ID NO: 49675 - DNA, 355 bp, Homo sapiens
gacaaggattctcaggtatttatccagggtaagggcaagggcttttctgcagtccaggacattagaagagtcctgaaccaagaactccacccctgccccgatatcagctgtttttactgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtgtatggtgttctcctgtggacataattgtgcacaagggtcagaagaaatt

SEQ ID NO: 49676 - DNA, 460 bp, Homo sapiens
taaatttgataatatgatcctggctggttggttgggattttacagattaaatttttagggggattttcttagtaaaaacataagagaatgtttagggtcatggcatttcttgctctagtctttatttcattttgggggagacacagaattgttcttcagtcagctctgtgtcagaggagagagtaaagctgttccttcatcatgcaatagtaatctgagtcaaggatatgaaacaagcccttcaggaagtgagccaattaaatgttattcttcagatatgaagttaataaacaaaatatagtaaagcatcaaaactttggagaatcttatattccctaagtggtagaaataaattgatgtcccatgataaaaataaacgagatccatgggaaatttttcttgttcttccccatcatgttgtctcatctctcacacattatgcacaatgatatgagaaaat

SEQ ID NO: 49677 - DNA, 392 bp, Homo sapiens
tggtgaatagttttggagtcagacaaaatcaggtttaaatcctgctacggttactagctgtttgaatacagacaaaaaagtttcctaaatagtaccacaactgtagcatagagacaaaatcatattagagtgtgttaggagaagtaaattatataatgtgtacaaaatggtgcataatatgccctgaataagtggttttttcttgttattgttgataagcttcaatgtgactgagaattttttattttaccttactcagaaggcactttacatccttaactacccaaagtgtggtctgcagactgacatatcagcattatcctcttagaatttgtaagaaatgcagaatcttgggccccaccccagacctactaaaccaagatctgcatttt

SEQ ID NO: 49678 - DNA, 107 bp, Homo sapiens
tacatttacaaaggtgcaaaaaagcatcttgcttttgcaagaaatagtaacatcattcaatatgctttcttatttactaaaaccttgaaataaaattgtaaaacatc

SEQ ID NO: 49679 - DNA, 296 bp, Homo sapiens
aaggaaataaagtctccaaatgatgctgttgcatagttaagaaatatgaccttcctactgcccagaaagagaatatgaggcgaaatcaatgaagagagaaatttcagttatgtttcttgcccttgctctccagagcatcattcagagttatttttctttattctgagacaattttattttgtcctcaaatcctctggatagcatttacatatgtggttgagtctgtaatcctagagatacttggctaaaactaatacctgctggttagtcctgaagttaaagttacgttttcctaa

SEQ ID NO: 49680 - DNA, 388 bp, Homo sapiens
ccacagctaaactccccataatatgattttttgttacatagaggctagttttctttcccccaggagaggtagtatataaacgctgtagggaaccttcagaagtcaatgctcttactagaaatctagggctccagggaccaaaaatcaggaagtatgccctttccccttaaaactgcaaaataaacagatctctagggagagggtctccttcttggtaggcatgcctgatatatttgcccctaaagtatcatattctaagatcagagtttaacattatgttctaattatctgaatgccataaggggcacactaagttttccattaaataatgttttcttttattcattatataacttcaaatttaaatacctgctcacaaagaatctac

SEQ ID NO: 49681 - DNA, 366 bp, Homo sapiens
attagaggcatgagccactgcatccagcctaccataacttattaaatcagtttcccacacttggacagtgaggttttttccaattttatttggtattattaaaagtgctgttttaaacattcttgtgtatacacgtttgtgtacatccctgattacttttttaagaataattccctagaaggagaattctactttttatgccattaccaaatggccctctgaaaagtgattgccccagcttagtcttgccacatcagctttaaaaagtgacattgcacctggggcagattattttctcactgcctcacttcatcatcaatagctgcattcaaggggaccggaaagcttcagctttagctgtgactt

SEQ ID NO: 49682 - DNA, 338 bp, Homo sapiens
agatgcagtttttcgttagccacttcctccttaaaggagaccagtgggcggagggggaggactcctctgtgtgcctgttaccagtagcgaatctgatgcatctgcagcaacctcaattcttacctcctcagaagaaagaattcggccgaggggcataaggtagggagaccgagaagttttagaggagtgaaaatttattaaaaagttttagagcaggaacagaaggaaggaacgcgcacctggaagagggccaagctggtgactcgaacggttattgtgcagtttggccttttgacttgaggttttatacattggtacgtccagggtcttgtgtccct

SEQ ID NO: 49683 - DNA, 407 bp, Homo sapiens
aaaaaggaatatttcatatgtgagcttaaaaaatcattagctctgttatattgaatacttgcaaaatttcattaaaattgtttttgcagaattttatgatagaataaattacttttgtgtatgtattgatgaaatcatggagttatatgagtttggatttctcaagcacccaaatagtcaacatcaagaatcagggaattaggaggttagaaagtcacatctttagtttttttcaggaacttgcccaggaacagaggggtcctaggtgggatgaccagaccccagttctctgttcttcagcccagtgcttttttcatgacatcactcaagtcagattttaaatttgtgcattacactggctttatttagaatcctgtgccaggcaatatagttttgattagaagctg

SEQ ID NO: 49684 - DNA, 384 bp, Homo sapiens
  misc_feature (4)..(4): n is a, c, g, or t
  misc_feature (21)..(21): n is a, c, g, or t
gccntctcagatggtgatatntcactgctgatgtcatacaccagcaatcatcttttcaggcagtttctcctcctttctctctctgtttaacttatatgctatcattctttgatattttttctttctttttctcttttcacagaattgataaaaaaatgtctggaggccagagcgggtatgaactcagtgaagccaaagccattctaacagaactaaaatctatcagaaaggcaattagctcaggagaaaaagaaaaacaagatctgatgcaggtacattataaaacattttgttaagccaaacttctaccttctgaggcccccagaaactcttactggggcagaagtgctccctcagagtctggatgacccttctacctctgcc

SEQ ID NO: 49685 - DNA, 1235 bp, Homo sapiens
aatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtc

SEQ ID NO: 49686 - DNA, 463 bp, Homo sapiens
gatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataattgactttttgcaggtcttacgataaaactaaaattatctgtaccttatttggtagcaactggttattctgacagttagtgaaaataataacttatattctagcattaaaattactggctaagatattttttaaagtctttttcataagtagttctgatgtagtcctacttatttaaaacttaaaatgtatttattacgtttgaccgaatttttggatttattgaattcttttaaagcttcacataagaaaaagggaataatatgttg

SEQ ID NO: 49687 - DNA, 823 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaactccctcatggggctcgctagtgtggtgctggggaaaaagcgaggcgagccgcctgtgttgtgttggctgggcggttactggggtggtgcctgcccgacgggggcggtccaccgg

SEQ ID NO: 49688 - DNA, 918 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49689 - DNA, 1040 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccgtgagtggcccctgctggaccgtggatcccgggcgggcgtgcgggcggcagcgtacgaggccttctactcgcccgggtgtccggtgcctcgcttctccctgggaccctgtcgtcaacatcgaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49690 - DNA, 949 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactaaaaaaaaaaacccgggtctttttggcggcga

SEQ ID NO: 49691 - DNA, 1668 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccgtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcttcacagccccacattcacctgttcttggtacttagcgtttccgcccatcctgtcctcctctatcagaacccccacaattgctctgtcctcggtgcccacagtctccaaaacaccagtgcaccggcccgcgtcatcccccgctctcagtcgtatcaaggactccagggcctcacccatagttctggagagggaagctgaacttgcaagccataacttcttttggggcatggcgatgaaggaggggctcgggccagcacttggataattttcaggtctacctgtccccctttatgtgtccccgggacaatcccagtgttctcagctgctcccttttggctcctcattcctgcctccagtctccgttagccccttcccatttggcaaggctcccgtgaccctgttctgcttcttgccctcctgggccccatgccctacaactgggcctcactcacatctgtctcaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49692 - DNA, 1232 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccgtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcttcacagccccacattcacctgttcttggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49693 - DNA, 1128 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccgtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49694 - DNA, 1071 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccgtgagtggcccctgctggaccgtggatcccgggcgggcgtgcgggcggcagcgtacgaggccttctactcgcccgggtgtccggtgcctcgcttctccctgggaccctgtcgtcaacatcgaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactaaaaaaaaaaacccgggtctttttggcggcga

SEQ ID NO: 49695 - DNA, 969 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactacaaaaaaattaaaaaaattggagattaaaagggggggaaaaagggtatgga

SEQ ID NO: 49696 - DNA, 990 bp, Homo sapiens
  misc_feature (982)..(983): n is a, c, g, or t
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactaaaaaaaaaaaaaaaaaaagaaaaaaaaaaaaaaaaaaaaaaggggggggggcaaaaaatccccnngggggcc

SEQ ID NO: 49697 - DNA, 712 bp, Homo sapiens
cgctcggtaccctcacaagacctgactcaaaaaaaacaaaaacaaaattctttggtttaccagcccggcagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49698 - DNA, 864 bp, Homo sapiens
tagcgctaggtacgaggctgggtggcgccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggaaccacaacccctctgtaataaaagagatttgacacta

SEQ ID NO: 49699 - DNA, 389 bp, Homo sapiens
ggggtcgactctcgaggattccggatgtcacgggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 49700 - DNA, 3263 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49701 - DNA, 585 bp, Homo sapiens
gactctagagatccccagcggggaacaatcacttcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaaggtatgatttgaccgttcacttccaaaccagcagtaaatatgttgttagacccgtggtatctggtatcgctcagtggacttgggatttgagagtggtcgccatccacccatgactgatggtgtccagatagtttctggaattctgctgtaggtcattccaagcactaatctcaccataaagtcagtgtgtagcttctcagttaacgtttcttccacgtgtattccagcttaacttggtggtgtgcttggtaagccctgcagtggaacggcatcatacacatgttaaaagtgattgttccccgctgggatccttagacgaaacg

SEQ ID NO: 49702 - DNA, 429 bp, Homo sapiens
gcgcagtgttgggactgtctgggtatcgttaaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49703 - DNA, 935 bp, Homo sapiens
gatgcggtgttctgaagcactgcatgccgcggagatgtcgcatctgatggagagtaactgcaacgtggagagttcacgttggccatctccagtcttgtatgacagatacttaacttgtgtttgaaattttcagagatcatttccatttttgcatagcaaagaatctatttcttgtcctctagctagaaggctttgcatggctagaataaatttcttttcaacgaaacggtatgctctggcaaatcttccttttggttcaaggcagcccactaaacccgctggcgtgtgttgatgaagtgtggtgcaggtgcagcgtgccactgcagcttctgggcagcctgagttggtgccatctaggtacgctcaggcttctgttccacaagtaaccgccccagcctggtccatagtttgctgctccagtagatggcaaataacaaaagcaaatagaacagatgtatcccctcttgcacagcctcacctaccagtcggctagaaaagcccattgggtagttggggagaaaatagcttggtaatgccgtgagtttgttgggtgtctaactgaacaatttgctgctctagataagtgggcggaaaaaccagcctttgggactcccctagaagaacacctgaagaggagcgggcgcgagattgcgctgcccattgaagcctgtgtcatgctgcttctggagacaggcatgaaggaggaggtgaggggagcttcgtgatcctgtgcaccaagtctccatgccccttgttgtacccagagcaccatgctccccgccagccccctgtccacccctgcttagttatacagccattgtccgttttgtgtagaacagtggctttcaagcttttgtcaccatgatccatattttaaattgcaaccctgttccctatgatacctatctgtctatgaatgaaacaaaggttttaca

SEQ ID NO: 49704 - DNA, 924 bp, Homo sapiens
cattagtctggtccttgccgcttcactgcatgccgggcagcttgggtggctatccccatgtgtggttttaacacatgtggaccgatgggcttctgtctcagtagtctgctcgcatggtgtgttgactgtttcttctctctgtgtagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcaggtaaggaggctgacttctgctggcagtggaggctggacgccccagccttcttgcaggtggtggcctttgagcacggcatccatgcccaaagaactgctccagcatggagtgaacagatttactttcactcctctggttggcaaaagatggaaaaaaagactatgaatggctcgcttctttttatgttttccaaagaaagcaacattggtttgcattctttgccacactgctttggtgctggaaaccggaagccagtggatgtctcatagtgtgatgagcctctgtcacctgttggatgtatactgtcagcattcatgtaccttctgttcattgtcatccagtgtgctaaccaggaagcatttgagtgtggcaagttagttaaattttcgtattcctggcatttattcacccattcgttgattgattcagtgaaacagatttactgagtcactgatatgtgctaggcacatgaggtgactaagactccactccacacccccagatttcagtcttgtagggcagttgatccatgagtccaaggtgg

SEQ ID NO: 49705 - DNA, 1392 bp, Homo sapiens
gttcatattaagtacagaatttcaggtataactttaaaaaacatgatttatgccaaattgaatgctccagaagggagatctcagggcactgtcatgttctaatggcttgggagggaagaatcaagattttcctgtagacccagtgggaacctgtttggaagtggtggtgattgtacaggttttagtgggctacctaatggcatatttttaatagtctagaacatgaccattttatttaacatttcaagaatatttccatcccaaatgctctaatttattatttaatttaaggatgaatatgggggtttctagtgtgtttttaaaaatggtaattaggggcctcaaataatttcttacagcagcctagtttaaattgttctaagtggaggcactttcggaaaagaagctgaaatacacctctgggctttccaaccatattgagtgactttgcagctaaaaatgtgccaaggtttccattaacccaaagggtgacggttaactgattctaacagcttttgataacttttttcaggaatataatacataatttgcacatgttataaatggttaataactttttttctgatgccatcagagcttttattttgaaaacaacaaagccatgttggtttgtttgttttgtttcccaatagatgcccttcctagtgccctcacaggtggggaaggtttccaggactaaggtctgtaatggccccgagcagcttgccccatagctcgccccacagctccaaatgctcctgcttagccgtgttttgcatatgtgcttttgaccatgtgctcaggagcagccgtttgaccgtgtgccctgacagccaataggccatccattctgtagcatattgacatttctttatttttatcagaagcactttgagctgcagtgcttcaaattcgaggagtagatgtcagtagatcaagagcctgatttcaagctgctcttgaagagtatcttctttcttaggggccaagcacagtggctcgtgcctctaatcccagtactttgagtggctgaggcaagaggattgcttgagctcaggagttcgagactgcagtgggtagtgattgtgtcactgcacactgcagtccagcctgcatgacagagtgagaccctgcctctttttaaaaaaaaaaaaaaaaaggaatatcttctatctttttggtgagcctcttagcagcagtctactcttcccagtgtgatttacctgtcactgatgggctcaccagcatccaaccaaagaggacccaggtgcagtcagcacgggaggaaattgtgtcctttgtgtcttgagctttaattttaaatttttgtattttaagtgcaagttaactgcatggagcttcttaatttgatattttaaattctcaagacca

SEQ ID NO: 49706 - DNA, 662 bp, Homo sapiens
actaatgttattcactctttggtgaccttgacaaaatggagctacagagtttggtataaaaagttctgggccaggaaacaggaagcctgaattctgatctctatcctgctgctaccaactctggacttcgagtagtcatttagcctctgagttctccttcttcagtccaagttattgataataatcaagccctttatcatttagggtcttattttgccatggcttttgcttagttttgtacagtgtatatgtcaacatgtaaaagccatttcatggtattaagtactgcccaatttaagtccaaacgcagtagaactgaaaactccgcattggttgctttgaaatggtctctctgatgatactggagtggcagagtcgttggagtccagtctgatgcaacgaatctcataaaataaatagtcctatagtcccggctactcagggtgctgaggcaggagaggattgcttgagtccagaaatttgagaccaacctgggcaacatagcaagacctcatctcttaaaaaaaaaatggctaatttttgtatttttagtatagacggggtttcaccatgttggccaggctggtcttgaactcctgacctcaggtgatctgcctgcctcggcctcccaaagtgctgggattacaggcatgagctaccac

SEQ ID NO: 49707 - DNA, 3240 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49708 - DNA, 3474 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49709 - DNA, 3415 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49710 - DNA, 2840 bp, Homo sapiens
taacaaaacatatttatctgtgcccccaaaaccggaaagggcgagcagataattggaccaaaaattttcattgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49711 - DNA, 3259 bp, Homo sapiens
gatgcggtgttctgaagcactgcatgccgcggagatgtcgcatctgatggagagtaactgcaacgtggagagttcacgttggccatctccagtcttgtatgacagatacttaacttgtgtttgaaattttcagagatcatttccatttttgcatagcaaagaatctatttcttgtcctctagctagaaggctttgcatggctagaataaatttcttttcaacgaaacggtatgctctggcaaatcttccttttggttcaaggcagcccactaaacccgctggcgtgtgttgatgaagtgtggtgcaggtgcagcgtgccactgcagcttctgggcagcctgagttggtgccatctaggtacgctcaggcttctgttccacaagtaaccgccccagcctggtccatagtttgctgctccagtagatggcaaataacaaaagcaaatagaacagatgtatcccctcttgcacagcctcacctaccagtcggctagaaaagcccattgggtagttggggagaaaatagcttggtaatgccgtgagtttgttgggtgtctaactgaacaatttgctgctctagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49712 - DNA, 1991 bp, Homo sapiens
gatgcagtgtattcggattgtattgtgttaggcccgaacttgtcatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49713 - DNA, 3523 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgtatgacctgccatattcagtaagaactgagattggaatatttaatgactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49714 - DNA, 1883 bp, Homo sapiens
gattctagaggttccccgcggtacgctgactggcctacctctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49715 - DNA, 1875 bp, Homo sapiens
tcccccgcggtgtcatagctgacggttcttccctgaaaaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49716 - DNA, 2414 bp, Homo sapiens
actaatgttattcactctttggtgaccttgacaaaatggagctacagagtttggtataaaaagttctgggccaggaaacaggaagcctgaattctgatctctatcctgctgctaccaactctggacttcgagtagtcatttagcctctgagttctccttcttcagtccaagttattgataataatcaagccctttatcatttagggtcttattttgccatggcttttgcttagttttgtacagtgtatatgtcaacatgtaaaagccatttcatggtattaagtactgcccaatttaagtccaaacgcagtagaactgaaaactccgcattggttgctttgaaatggtctctctgatgatactggagtggcagagtcgttggagtccagtctgatgcaacgaatctcataaaataaatagtcctatagtcccggctactcagggtgctgaggcaggagaggattgcttgagtccagaaatttgagaccaacctgggcaacatagcaagacctcatctcttaaaaaaaaaatggcaccaagtaaacattagctctttatatggcaccaagtaaacattagctttataagcccagtgtgagctagttagaatttcagatccttttcctgcctgccgaagtgaaaactctgcttggaatcttatgttttatgtgcagtatgttcagattttctagctgggattgtctgacgtctaacttgacttttactcctcttagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49717 - DNA, 1592 bp, Homo sapiens
ggcaggaggatcacttgagcccaggaggtcgagcctgcagtgagctatgattgcaccaccgcactccagcctggacaacagactgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49718 - DNA, 3522 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgcccttcctagtgccctcacaggtggggaaggtttccaggactaagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49719 - DNA, 962 bp, Homo sapiens
gggtgactctagacgatccctatatccagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49720 - DNA, 979 bp, Homo sapiens
attcggaacgagggcaccaacagcttccaagatagtaacagatgtatgacctgccatattcagtaagaactgagattggaatatttaatgactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49721 - DNA, 917 bp, Homo sapiens
ttacactcggcgatcgagatataccggactccatttccaacggtgcatcatctgtatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49722 - DNA, 3212 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttttttttttttttttttttttttttttttttttttttttttttttttttttttttttttttattattttatatattatttt

SEQ ID NO: 49723 - DNA, 3324 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagatgcccttcctagtgccctcacaggtggggaaggtttccaggactaaggtctgtaatggccccgagcagcttgccccatagctcgccccacagctccaaatgctcctgcttagccgtgttttgcatatgtgcttttgaccatgtgctcaggagcagccgtttgaccgtgtgccctgacagccaataggccatccattctgtagcatattgacatttctttatttttatcagaagcactttgagctgcagtgcttcaaattcgaggagtagatgtcagtagatcaagagcctgatttcaagctgctcttgaagagtatcttctttcttaggggccaagcacagtggctcgtgcctctaatcccagtactttgagtggctgaggcaagaggattgcttgagctcaggagttcgagactgcagtgggtagtgattgtgtcactgcacactgcagtccagcctgcatgacagagtgagaccctgcctctttttaaaaaaaaaaaaaaaaaggaatatcttctatctttttggtgagcctcttagcagcagtctactcttcccagtgtgatttacctgtcactgatgggctcaccagcatccaaccaaagaggacccaggtgcagtcagcacgggaggaaattgtgtcctttgtgtcttgagctttaattttaaatttttgtattttaagtgcaagttaactgcatggagcttcttaatttgatattttaaattctcaagacca

SEQ ID NO: 49724 - DNA, 3037 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacaggtaagtaggacatcaatgcccgtatttcctcgtctgctctacattgcttttgtactactacattttatttaagctttgatttatgccaggtgtcagcaaactacacccgcaagccaaaccaaacctgtcctgcagccagtttttgtcattaaagttttattggaacacagctacacccatttgttaacatattgtctgtggctgcattggtgctgaaacagcagagctgggtagtcgtgaccaaagatcctgtggcccacaaagttggaaacatttactgcctggtcctttaagtttgccgacccctgacttatagttgcttgtgtgtttaagacctatgtacgtttacatttttctcaacataatggcttttattccaggtggaaggtattttacaacacgagcatgaactttatttcttagtgaattcctcattaaaatgcttaaacagt

SEQ ID NO: 49725 - DNA, 1854 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagctgcttcctgtccgtctcattccccgcaccctgccctcccccgcaaccttcagctcctctcgccacgaga

SEQ ID NO: 49726 - DNA, 473 bp, Homo sapiens
ggggccttgggtgtaccagcccccccccggattacgggtggcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttataaaaacttcataaaataggaggta

SEQ ID NO: 49727 - DNA, 1568 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttaggtatgtatgattgagctacaatgactctggagtgaagataagtttaatgcccagcagagaagtcatttaattcaggcatacttggcacattaaaaaacaacaacaacaacaaaaaaaaccacatcactttggagagtaacttggggctactgggaatgggatttcatgtatattatgatgaatttgaagcatcagtatcatgcctgacattaatacgtaagttggcttatcattttcccactacagctattagcaataaatttcttgtgaaaagtttgagtgactgtatgttgggtttggagtccaaatcatccagtatgttaaaaggcaaaattaatcaataattgtacattctgtaatgtcttttatatatgctacttaatttaaagtataaatcatcttactaaataaaatttcaaagaatggagat

SEQ ID NO: 49728 - DNA, 2338 bp, Homo sapiens
ataaggcaggctggtacggtccgggatttaggatggccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcaggtaaggaggctgacttctgctggcagtggaggctggacgccccagccttcttgcaggtggtggcctttgagcacggcatccatgcccaaagaactgctccagcatggagtgaacagatttactttcactcctctggttggcaaaagatggaaaaaaagactatgaatggctcgcttctttttatgttttccaaagaaagcaacattggtttgcattctttgccacactgctttggtgctggaaaccggaagccagtggatgtctcatagtgtgatgagcctctgtcacctgttggatgtatactgtcagcattcatgtaccttctgttcattgtcatccagtgtgctaaccaggaagcatttgagtgtggcaagttagttaaattttcgtattcctggcatttattcacccattcgttgattgattcagtgaaacagatttactgagtcactgatatgtgctaggcacatgaggtgactaagactccactccacacccccagatttcagtcttgtagggcagttgatccatgagtccaaggtgg

SEQ ID NO: 49729 - DNA, 1091 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgataagtgggcggaaaaaccagcctttgggactcccctagaagaacacctgaagaggagcgggcgcgagattgcgctgcccattgaagcctgtgtcatgctgcttctggagacaggcatgaaggaggaggtgaggggagcttcgtgatcctgtgcaccaagtctccatgccccttgttgtacccagagcaccatgctccccgccagccccctgtccacccctgcttagttatacagccattgtccgttttgtgtagaacagtggctttcaagcttttgtcaccatgatccatattttaaattgcaaccctgttccctatgatacctatctgtctatgaatgaaacaaaggttttaca

SEQ ID NO: 49730 - DNA, 339 bp, Homo sapiens
catgagccacgatgccaagctgatttttctttattattataattgatttattttttagagataggttcttgccctgttgcccaggctggagtgctgtggcatgatcatagcttactgtagcttcaaattcttgggctcaagtgatcctcctgcttcagccactcgagtagttaggactacaggcacccaccaccatacccagctaattaaaaaaaaattgttgaccgggtgcggtggctcacatctgtaatcccagcactttgggaggctgaggtgggcggatcatgaggtcaggagatcgagaccatcctggctaacacggtgaaatcccgtctctac

SEQ ID NO: 49731 - DNA, 278 bp, Homo sapiens
agagtgaaggacacagcttttaacatcaggtagagaattttgttgagtctttagtaggtcagcctttggaaaatacttctctaaatttctatacattcgggctaactcattagaggtcaggcctggaagatgagatcatctgtttcttcaagaggaggacctctgcttctgtcaaaacagctgagtcaacagggcgtggtgtctcatgcctgcaatcccagcactttgggaggctgagatgggagggtcacttgagctcaggagtttgagaccagcat

SEQ ID NO: 49732 - DNA, 421 bp, Homo sapiens
atttttttgtgaccagaagtatgctgtaggaacttaactattgtttatatcagttagcctatgctaaaattggttttgttacatgtcattttgctttaactcttagtttccaagaacccatggttgacgttaagacttagtgtatattcatgtatgttatattcaataaaaagttttctgttaatatacttgatttgatataaacatgagtaaaatagttaaattccattaaaaatagtaaatgagtctatttcttctatgtagatggagtaccacttacagaaactgttgaaaagtggcttcacaaataacatcattgtcataattataatttttgatttgcttagcaaatcatgtggcaccccactaccaccactgctgcgttgtatgtctgtgtgtgtatacattgctaagagattct

SEQ ID NO: 49733 - DNA, 419 bp, Homo sapiens
ttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagtt

SEQ ID NO: 49734 - DNA, 404 bp, Homo sapiens
agctggtctgggtccagggtcccagtgctgatattcttccaagaccataggccataagggcctcagtcactgggagggagtagactaaggcaccatggaggcagcagtggaactttatttttgaaagtttatgtaaaggccggttgccgtagctcacacctataatcccagcactttgggaggcagaagtgggcagattgcttgaacccaggagttaagcatcctgggcaacatggtgaaaccctgtctctaccaaaaatacaaaaatgagctaggcatgatggcctgtgcctgtagtcccagctactcgggaggattgcttgagcccagtaagtcgaggctgcagtgagccatgattgcaccactgagctccagcctgtgcgacagagtgaaactgtctcaag

SEQ ID NO: 49735 - DNA, 449 bp, Homo sapiens
aaattgacaaatactaaacctcccgaaaacctctttggaaagatagtcacagatgtgtctgtggctttgtttttccccggcaggtcctacagctggcttagtaaacctcaatgactgagacttatgcctgagtcactcattttggttgtcaagtattaggaaatactaagaaataactggtattttgttcagtgtgataatagtattgtggttttgaaagaaaatatttttattttaaaatatatttagcaaagcattttgaggtgaaaagacataattacaggaatttgctttagaattgtaactaaaaaaacagtgatagatgaattaaataggctaaacagtgttaattattgaatttgggatatcagtatatagagttcattttactattctctctacttctatatatgtttgaaaactttgataataaaatgtaacaaactaca

SEQ ID NO: 49736 - DNA, 607 bp, Homo sapiens
tccccacgggtggaccaaacacctccaaagagatttgggttttatcaagagtatagcaacgtatttattttttatttttattttattctttgagatggagtctcgctctgttgcccaggctggagtgcagtggcgtgatctccgctcaccgcaatctctgcctcccaggttcaagtgattctcctgcctcagcctctgaagtagctgggattacaggcgtgtaccaccacgcccagctaatttatgtatttttagtagaaatggtgtttcaccatgttggccaggctggtattgaattcctgggctcaagtgattcacccacctcggcctcccaaagtgctgggattacaggcgtgagccaccgcgccaggcctttattttatttttttaacatattgtaatgtagaaatgcccgggcccagaacactacagggaaaaacaagaatcctctcaaatttccacaatgcccccagggcactcacccagagaatggatctgattctgttactctcttccctcatctctttccattttcttcaatttttttaaatataaagagcttgtattatttttaaacaaagaataaagttattttttaaacgttggg

SEQ ID NO: 49737 - DNA, 810 bp, Homo sapiens
gcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaagtaaagttgcctaaaacaagtgaggagcttagggaggggactaatggccaaaggtcagaaggagttgggtcatctctaacccccaagccctcctcctggcaagaagggagttcctcatatccttagagcttcctccaacccattttgtataggatcactggccccttttgctcccactctctttccttagctgccccaattaccctgtgatctccctccagacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaaaaataggt

SEQ ID NO: 49738 - DNA, 608 bp, Homo sapiens
gcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaagtaaagttgcctaaaacaaacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaaaaataggt

SEQ ID NO: 49739 - DNA, 358 bp, Homo sapiens
caactatcaacagctctctcctgcctgtccagcctgggcatcctcagcctatgaaatccatctgcctctctagtccaccaaccctataggcctatttgccccacacaaggcctctagaacaccctccttctgcatgactcatcagggcactttgtgaagagtgaggcgatcttgagggcatgttcatcttcatcaaacatggaggtgaggggcagcacagaactagagtctgtggatgggggtggagggatctgagggcagtggagatcacagaaatgggcccatgtgtcccatcctatctcttctcagataatcagcagtttctggtcaataccaactgtgctgtcgtcgtgttgct

SEQ ID NO: 49740 - DNA, 333 bp, Homo sapiens
  misc_feature (24)..(24): n is a, c, g, or t
cccctgcgcaaggatgacacgcanattcgtgaagcgttccatatttttgtctctagttctcagaggtgcaggtgccttttccttgttcttagttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaaaaataggt

SEQ ID NO: 49741 - DNA, 799 bp, Homo sapiens
ggagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttccttggttgtttcccattgttcatttctctcccataacactgaaaacagggtttttttttgttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttgtatcctttgacctatatctctgtttcctcctcctgttccctaccatggtcgccatgttttattctctgtgtttttgagctttttcttttatatatattctacatataagtgaaatcacttttctttctgtgtctggcttatatcatctagtataaggtcttccaggtccatccatgttgtgacaaatagtaggatatcgttttttaaggctgaataatat

SEQ ID NO: 49742 - DNA, 283 bp, Homo sapiens
ggaatattaaaagtagatccagtcacctaatgtaataacccaaatatccaggtttcaatgaaaaaaacctctcataccaagaagcaggaaagtgtcagctcaaattagaaaagacagttaatacatgctgacactgaaataacacagatactagaattatttgacaagaatttttttattgtactttaagttttgggatacatgtgcagaatgtgcaggtttgttacataggtatacacgtggcatggtggtttgctgcacccatcatcccgtcatctacatt

SEQ ID NO: 49743 - DNA, 409 bp, Homo sapiens
tctgcaaggtgttatttaccaaagaggtttgtaaaccagatgtctcttctcttgaacactaatgaataaaatcttgtattttttggctttctcagctaatcattacttaaaccttcagcttaaaaactggggaattgaaatccctgtggctggctagtcctctgaaggctttgtgatgatgtcactctcagatcgggacagaagcattcaagagagggataatactcttgcttatgtgacagctgtatgtgtccaagagcatttggctacattcagtgatttgatggccttgttctgattacagagctctttgctatcttcttcctttgcattgaattttgtcaaatttcccaggtattctctgaagaaagttcctctttagttgtcaatcaccacctgtccatcagag

SEQ ID NO: 49744 - DNA, 426 bp, Homo sapiens
gagaatttggtttctgggatttcgtgtaattgttttctgttatatacaatttttatatagttgtcactagtttgcacataattatttcctatttgacatattaacatgtgtcacatggaccatatacttgcatgatacattcatttccttaattattccagttgtatttgcattctagttttccacttacttaggatctgactttccattagaccttcagttcctcagaggcagagaccatgattgtattctttatgatgtccctgggcattgttggtatctggggtcattgcagaagaagaattaatgtatgctattaaagtcagctctctgtatccatgggattccacatctgtgggattcaaccagcctcaaattgcaaatattaaaaattgcatttgtactgaacatgtagagtattttttc

SEQ ID NO: 49745 - DNA, 799 bp, Homo sapiens
ggcaggcgttgcccagtccccatcttgtgttttacgaagccacagtgaacatcagggccatttctttattgctaggctgcatgtatgtttccagcccaaccagcttcaaatccctgtattcactgtggctgtttgtctaacgccgcagacgtccagacctctcatctttctggtgcacgcgtgaagctggagaccgtgctgcacatgtgtcattctcgcccagcctgtcacccgccagctcaccgccaacctgagggccccgtgttcaggcctttgtgttacaaccttgtgctcatttgctaattactgagacagggagccagtacttgtttattcctttgaaaagtttcttaggacacagtgcttcattgaaaaaaagagggcatgaagcgtttataccggcaggtgcttcattgaaaaaaagagggcatgaagcatttataccggcagacctgtttgctgctttttagctgtgttaaaacttggtctacaaaatattctatataacatgaggaaggaaatgacattcccctttttcatttaagaaggaaatattgggcattaattctcagtattctttatgaagtgaaaactttaaaatgaaatcacaatagaggcttttttttgttttttgtctttctcctttcagcatttctgtaccaagcgaggcttggggcgtgacctcgtcctccctgcatcgtcctggctggtacaatccacgctgggacccggggagagggccctacttggagagggttctcattcctcctgtgccatgtaaaatctgctttcccatctg

SEQ ID NO: 49746 - DNA, 405 bp, Homo sapiens
ttgaaaagaactttgaagagagagttcaagagggcatgaagcatttataccggcagacctgtttgctgctttttagctgtgttaaaacttggtctacaaaatattctatataacatgaggaaggaaatgacattcccctttttcatttaagaaggaaatattgggcattaattctcagtattctttatgaagtgaaaactttaaaatgaaatcacaatagaggcttttttttgttttttgtctttctcctttcagcatttctgtaccaagcgaggcttggggcgtgacctcgtcctccctgcatcgtcctggctggtacaatccacgctgggacccggggagagggccctacttggagagggttctcattcctcctgtgccatgtaaaatctgctttcccatctg

SEQ ID NO: 49747 - DNA, 533 bp, Homo sapiens
ttttttttaggggagacggggtttcaccgtgttagccaggatggtctcgatctcctgaccttgtgatccacccgccttggcctcccaaagtgctgggattacaggcgtgagccactgcacccggccaagctttacaactttatttttagggacagggtctcacttttttgcccactactgcagcttccaggagaaaaagttattcgcctctgccgtggaatattctatagcctaatccacgtgagcaaaagacacaactctaccaagatataaaatgtgtactacatatacagtcgtgagcactaggctgtgacctcgaatgccaacaactatggccaaattactgacagacataagcctgagaactaagccagacactcaacagaaacaagcctcccttttcagagacattttctaaaaccataaaaataagagacaaaaattaggacatattcaggtaacaagagcttccttcccccagataatttctgttgtataaaacccagagattaaaaacaacgatattggattag

SEQ ID NO: 49748 - DNA, 419 bp, Homo sapiens
aaaagatggtatagcaacataaaatttacaagaacattatagctggactgtataggaagagcttgactgatttctttccacaatgcattttcatcaaaactcatacatattcagagatacaaatagcataccagtgaattcaatgaactgccactgaaaccaaaacattatttcctagcatctgtttgtgggaattatgtaaaatacttaatgcaatgtgttttcattgcaatcctatttttgtttcccaagcagtgaattttcatttaaaccaatatgtttacctgagacccacacacatgcatttattggaactgaaatacagctacagatacaggcaacacgtctgaggccaaaccaatgcattttgatgcaactcagccaattttccacaacatgtgttctgattctctagggat

SEQ ID NO: 49749 - DNA, 538 bp, Homo sapiens
  misc_feature (530)..(534): n is a, c, g, or t
  misc_feature (536)..(538): n is a, c, g, or t
gcgccctggcagtcccggaagacaccaggaaaacaagcagaaaccgtagctaggactggggtggccaggcccaggaaatccatgaaggggacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgagcagcagcggccgaggaggaagaagcagctgcggcggccacaccctggatgagagctggagccctgcctgatggctggatggaggccatgcaggacaagttccttctaaaatcaatcctttgctttggcctggaagaccgaacatattaggctcaattttcttcgtgtagcagcggtaacataaaaatctgtcatacatacgatttttgggagaagagatagattgtgctgcaggccttttagaaataaacatgtcctcatcacagcannnnnannn

SEQ ID NO: 49750 - DNA, 504 bp, Homo sapiens
aaaagtataaaatgttgccttaagaactagatcctgctttgacaccagtcccaaatatcatcctctagatagaaaatcaccgaatctttctgctggatatcaggaaaaataattagaaataccaattaatcccaaagaagtgtagaaacatctgcattaaaacaaaaagatcgttctgtgtctctttctcctccatgacaggtaactgaatggttcacatcaggtaagcagaacatccatgtcccagacagcagggcggggaggagccctcaccaggaagagtgtctctcagctgtgatcccagcactggggctgaggatggaatcactgctgactcactagcaagcaccaagctgctggctgagctatcatttcctataactcattcatctgacactgcagaaagcaatttctccccatgccccaccccctaccactctaatcctcccaaaataaagccctaccactaactgcttcctgtctctgcataaagctgtatttctg

SEQ ID NO: 49751 - DNA, 1794 bp, Homo sapiens
gcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctaaaaaaaaccacaccaacatccaccacacacaaaccctgcgaggcctttatgccgggcggcgcaaacaagaggctctcccacccgcccccgggcccatacactgttcccgtaacccccgttccggtccccccagggggacccc

SEQ ID NO: 49752 - DNA, 587 bp, Homo sapiens
ttaaaaaaaaattatttgtttagggtctgtccctcccagtaaactgtagcttctaagacagactttgtttttgttctctgctatattgctctattcccacgtcctaaaacagcgtctgaaccatagaagtcactcaataattttctttttcttttttagtaattctagtgacccgactcaataaatttttttaaataaatgcatgagaaattgacaaattgtaacaagtccagaagaacaatagcaggttactgaactgccacatcaaataaggaacccttgaagaaagtaagatgtttaatctggagaagaaaagattgctgggcacggtggttcacagcctgtaatcccagcactttgggatgctgaggtaggtggatcatgaggtcaagagatcgagaccatcctggccaacatggtgaaaccctgtctctactaaaaatatgaaaattagctgggcctggtggtacgtgcctgtagtcccaactactcaggaggctgaggcaggagaatcactttaactgaggaggcagacattgcagtgggccgagatcacaccactgcactccagcctggcgacggagcga

SEQ ID NO: 49753 - DNA, 446 bp, Homo sapiens
taaaaatgctagattgaaaataaaccaaggctggttagacaaagctggttacagagttatgatagcagggctgtcatactagttttgaaaatgtatagtgcactgagatcaaaaagatgtccttgaataatattggtaacaggctaacctttcttcatctgtggtatcaggaaattacagggagttacagggaactgaacactctgccatatttaataaacattaaatataaatttggtagtatatttattattctttcccaaatctttacaaaattgttgtgagtagattttcctttagtaagaaagatttctccaattaaagttttagtaacaccttgctaattggtaaggcttattggtaagactaattcgtgaaaaattaaattctagagtgtgttgaccaaaatgtagtttttaattttgaaattgtgataaaataagtcc

SEQ ID NO: 49754 - DNA, 178 bp, Homo sapiens
caatcaacttatagggaattcaaaggctttttcagccaaactaaaatttaaactgctcctttaatttgaactgactctaaaaatgaaaatagtatttttccctttgtgaacaaattttacaaggagcagcctatttaataaacactagctttaaacaaagtataggcttttcagctga

SEQ ID NO: 49755 - DNA, 528 bp, Homo sapiens
gaaattgttgaaagctgcatgctggcttggcagaacaaataaactttcatgagagtgagtgctgtttaagcatcgatgcagctctgagcttcctattagaagagcaggtacctaccattccttcagatagaagtgctatttaccagcacgccacaacttctccctggagactctgtgtggcggacaccatataacacagtgaacagtgtcctcaatttgagttttcaagaaatgcagaggccacttaccaatagctatttcttccaacagcctctagtaaaacccagaagcataatatgatgctgtgtctcaggggcagtctttctgccagagaataagctaacaggggctggcgattcagtgtgtaggactccaaaccatcagtatgaatttttttcctgagctttgagaagggcagcattatcctcagcccctggggaatggaggttgagtagtaagtggggatgccatgctgggatattaggactaattgtaaaagcagccttgtattgacccagccctgggaag

SEQ ID NO: 49756 - DNA, 436 bp, Homo sapiens
tggtagaagtttttgagagctattcttgagagctggtgctgcctaaaaggtctcaattggattttaagttctaattttgtaagtctgtcaagctccaccacccatgaagaggaaggccagtgaacactgaaatattatcaacagcagtgtttatttaccatgctcctagaaggttaacaaaatacatagccacagggccgggcgcggtggctcatgcccgtaatcccagcactttcgaaggccgaggtgagcggatcacttcaggtcaggagttctagactagcctggccaacatggtgaaactccgtctctactaaaaatgcaaaaaagttagccaggcgtggtggtgggcacctgtaatcccagctacttggaaggccgaggcaggagaattacttgaggaggatggaggttgcagtgaggtgagtgagactct

SEQ ID NO: 49757 - DNA, 437 bp, Homo sapiens
tctcaaaaaaaaaaaaaaaaaaaaaaaaaaaggatttgatgtaaaccacacgaagaatcaacacaagtataatcataatgattgttgcagctaataattcattagagaagtgattatgttaacaacagaaacgtcacagttgattgactactgattgcattcacatgaaggtccagtacttttgttggtgtaatattgccctctgatcttttacaaaatctgggatctgaatcattcacatcttgagctgtacccaggaagttacatgctacattcacatttccaatggttaaaaaaaaaaaaaaaaaaaaaaaaggtatcttctagccacatctttccctcttttaagacagttcccgaagttcttattgtcatttgcatttcatttccatggcttttagtaagcttagtatttttgtttcttgtttatccgtcag

SEQ ID NO: 49758 - DNA, 327 bp, Homo sapiens
agtatatcacaaaaaaaagggcacgtgggtataaaaaaaaccccccctccccccccccaaaagagccccgttttttgaaaacaacggaaaagagttcaacggctggcgccacatccctcagaaaatgcgcggcaaaaagggggaaaaaaaaaaaaaaaagagcccccggggtcccaaaaaaaaaaaaaaaaaaaaaaaaaaaaaaggtatcttctagccacatctttccctcttttaagacagttcccgaagttcttattgtcatttgcatttcatttccatggcttttagtaagcttagtatttttgtttcttgtttatccgtcag

SEQ ID NO: 49759 - DNA, 253 bp, Homo sapiens
gttatttgtagctgccacaaaacacagatcacaccaagtttagtgtccactgatatctggaagactttaagggtattacattttaagtgctattaggatcttgagtaatcatcaaataagaaaatgggtattaaaatgctttgtaaactgtaagttaagataaaagtggtattcctgatgttaaccactctcaactgagcttagatttctagtatataccagcttgggtgacatagtgagacctggtctctac

SEQ ID NO: 49760 - DNA, 725 bp, Homo sapiens
gctttattcatgtgttagtcaagatcgagtgaagtaagaataaaacactctagataaattgaacaggaaaggatcgaatatagggaattacctgcttacacactgttcgagaaatttgggagtcaaagtcaaggatacttttgttggtatcaagaactcagaaagtgcagcaaaggcaagaaatgactacctaatatcttagcaacctagaacacttaatggggtcattctcaggaagatgcttggaagacaccaacaaaacactacatatatattaatgcccaaacgtccgactccagctgctgccagtgaataatgtcttctctttctcttcccctaccagggtttctgtcagtgatggtcattgggcagaatatgaatgcaaaccctacttgctaaagaggagctggggaaatgtttccagactttcagccctagtgatactggggagagttttgaagggcaaggacagaactgaatacaagagatgctgtcctgcttactcagcttaattcctttccttcaaaacaaaaacaaaagcacttgcttctcagaaggattctgttaatctatttatttacaccaaggtattatggaccaacaataccttcaaatgcatttttttcccccaggacaatttgtactttcacaagaacaaagatttgatttaaagaagcgaatccatctaattgacaactggttggaacagggactcactgacaaca

SEQ ID NO: 49761 - DNA, 399 bp, Homo sapiens
gtttaatctcataacacatactgcaaaagactggcaagtatgatagtaaaagtgattctctgaaaattagtgggcatttcaaactaaaaattattttttaaagtgtactggagataaaactggagaaataaagtactgaaactttattggaaagtgcatttaacatgagtaaaaatacatggttaatactaaagcatccaattatgttggatacttttttgtaaaactagtaactaccctagagaaaagaaagacatttttaactgtaaaatacattcattttttctttgatccaataaatatttattgagtgtctactatatgcaaagcattgacaaaaacacactgcttaacctcatggagtttatagacttttaaggaagacagttgtctaaaaag

SEQ ID NO: 49762 - DNA, 310 bp, Homo sapiens
aaaactggatgtttgatattacaagaaactttcttgtgactccaaaatggatttttttaaaacagtagaataaggagagaagtctcatatagctagtagtatggattataacatttttttaaacaaacaaatctttcctaaaagcagtttcccctcaatatctctaaatcctgaacgcggcatctgtgattctgcacccccggctgggatactttcatgaaggactgttttagacagggattttgtcatcaagagaagaaagaacaggacaacatcagcattacagccgaaacgcaaaccatctcaaaac

SEQ ID NO: 49763 - DNA, 840 bp, Homo sapiens
tacttttccacaggctcggcttgtgcttgtacatctgattccaagatgtgttgcacatcttttcagatgaccttcagcaaaatccattttattttcttgtctttctggagtgtgactttgtaagaggatgtgattcctgtgttttcagagtcaagattcctttttgcagagaaatgtgatgttgtgaagatccaggaacagactgtctcacccactttgttctttgtctctttccttttgtgtttatatcttccctttcgcaactcacaaatccttggccactgactctttagtgcctgtctctgtgtctcgtaccttcgctgtcagcagaggggactctctggcaggctccccagtaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaaggtaactcccccaggaaggttatcctctccctcccagtgggcagtgttggctggctgagcgggacaagaagactacccccatttctagaagggatgtgtgcaccattcccctgtgttccaatacagtgctgggtggtaactgctactggctgtataaaggctgttttcagtaagctttaggacggttcattatttgtcactcttttaacatctcctgacccccttttttcatgtggggaaatgaggcacaaagcaatagattagcttgcctgacacaaattgctgccagaaccatttcctttgcatcccctaccattggca

SEQ ID NO: 49764 - DNA, 3855 bp, Homo sapiens
tacttttccacaggctcggcttgtgcttgtacatctgattccaagatgtgttgcacatcttttcagatgaccttcagcaaaatccattttattttcttgtctttctggagtgtgactttgtaagaggatgtgattcctgtgttttcagagtcaagattcctttttgcagagaaatgtgatgttgtgaagatccaggaacagactgtctcacccactttgttctttgtctctttccttttgtgtttatatcttccctttcgcaactcacaaatccttggccactgactctttagtgcctgtctctgtgtctcgtaccttcgctgtcagcagaggggactctctggcaggctccccagtaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaacccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctcccccctcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagatgccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctggaatgtg

SEQ ID NO: 49765 - DNA, 4787 bp, Homo sapiens
ctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagtggtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaacccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctcccccctcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagatgccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctggaatgtg

SEQ ID NO: 49766 - DNA, 2720 bp, Homo sapiens
atggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcctccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaaaaatacaattgtttttgtttacttttactccatgggcattgaaaaggttaagaaac

SEQ ID NO: 49767 - DNA, 379 bp, Homo sapiens
tatggatgaggaaacacagaatgaataatttgccaaaggtcattcagctgactagaatttaaacctgtctaggccgggcgcagtggctcatgcctgtaatcccagcattcgggaggccgaggtgggcaaatcatctgaggttggcagatcatctgaggtcaggagttcaagaccacgctggccaacatggtgaaccgacatctctacaaaaatacaaaaattagccgggcatgatggtgggtgcctgtaatctcagctactcaggaggctgagacatgagaatcgcttgaacccaggaggcggaggttgtagtgagccgagattgcaccattgcactccagcctgggcaacagagtgagactccatctccaaaaaaaaa

SEQ ID NO: 49768 - DNA, 499 bp, Homo sapiens
ttagcagcttaacaataatcgtgatctctcctgatttctgtgggtcaggaatttgagagtggcttagttggacatgtgtggtgtggggtctgtggtttgggctgtagtcagatgttggctggggctgccatcatctgaagactggattggagctttcaaggtggtgccctcacatggttatcaagttcgtacttttccacgtggcctttccactagactgcttgagtgtccttacaacatggtggctgccttccccaagtgaacggtctgagagaaagaggcaggtggaggatatgccttttctatgacttggtctcagaagccacatgctgtcacttgcatggtattctgttggtcacataggtcaatctattgtgttttgagagcatgtgtacataaggtatgaatacaaggaggtgaagtttatttggagacacctcagaggctgactactgtgtatcctctttctgcaataattgcttcttcaccagtcccctct

SEQ ID NO: 49769 - DNA, 237 bp, Homo sapiens
aaaatatactaaaacaagagaattaggacaagaaatgatttaaagtagataaaggactatataaaacataattagatttttaaagtttgatggcaatgagaattacataagaaaaacaaggaaaggtatgtaggaagtgtcacaagtggggctagtagaaaacagccatctctgcgccatgtccaccgtggacaggccacttgtgctctccggctgcccctgagcccatctgcccct

SEQ ID NO: 49770 - DNA, 2930 bp, Homo sapiens
gggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgaaaaa

SEQ ID NO: 49771 - DNA, 2619 bp, Homo sapiens
gggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgaaaaa

SEQ ID NO: 49772 - DNA, 2820 bp, Homo sapiens
gggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgaaaaa

SEQ ID NO: 49773 - DNA, 449 bp, Homo sapiens
gtcaagctttttttttgttttaaacttcagtgcttaaaggcaataccagtactcctacccatggaggttcttgacattatcatggctacttgaaggatagttgctaacactctggctcttaatccctcaatgataagctcaaacactcccatctctgcagcaaaaatctctttttgacactgcaatactactagactttctagtttcttgagaagtcattttcatagccagtttcatagccagtcagctgggatgctagtagaatgaccctcctgatgaaatataagacttttactggttagaagccactttgcccttgagaaatctctgtttaacagacacttcctgggtcacacagacctaattacactctgatggtgcactttcattctttctgtagctattcaacaaatgccaccaaatgtaaatggagctaaattataaatggg

SEQ ID NO: 49774 - DNA, 427 bp, Homo sapiens
cctcctgtagctgtgaattaatattcattctggagttccaggtactcttccagtcacttaccacaataactgtatgctatatgggttctttttttattccagtttgatgtatgagaatacttaggcatagtgagttgcaaagctagaaagtagaatacgtggtataagaactcaggtaattgagccccagaaccgaaactcttaaattactcttacatttcttttgattttaaggtttatgttactgagatattttaaaaatagtcttttacagtacaacattcagagagaaagagcagaataatgatctaacctgctgttgccagtgaacctcatcgctatcccattgagcacatcattcagttttggcttaaaatatccttctgtctgcttaatgtttgagagtttctaggctgatattttcaaa

SEQ ID NO: 49775 - DNA, 501 bp, Homo sapiens
  misc_feature (498)..(500): n is a, c, g, or t
gttttgtactttctacttgcatatgctggttttataataataaaaggttattttaaaaagaaaatcactattttccgctgagcccagatacagcttctgaatcaccatcaacatgagactggtacattccagcatgggaggctgccagggcatcagtccagctggttacttcttcgaagaagtaactactgatttccttttgcctattgatttccattgcctatgcatcttacctgtggctcaagattaccttggcactaaatccaattagccttttcactttggcagcccttaccaattggcaacttctttgtctcttggtttgcttttgggcaaaaattaccttcttctttagtttttgagtcattatatcctcttggttttcttcctacctttctgacttctcagtctcctttgaaagtttacagcttctttaatttcccccacaattccatactcagccttctctcttcactctatatctttttcccaaaaaannna

SEQ ID NO: 49776 - DNA, 446 bp, Homo sapiens
ctcgggctactgctgcttcttggtggcaagcccctgtgcaccctgctccttgcctctggcggggcagcctgtcgtgcctgcttcctgccctgtgaacagcaggtccgtgcttcctggagccaaggaagactttggggtttccctgtgaaaggccctgtctccccaagcctggcgtcctctgaggctttggagagcccgggagagacggcacattgtccaagcacacagagatcacgtgcttcttccaaatggacaggactcagttattttctgtcaaacacaaagatgcagtatgctcactataaaaggcccaagcaatagacaagcgcagaaaatggaaagtgtgtcaggagaccattcccattgagcccacttcccagataatcgttaatgacaatttgatgcacgtggtggttccagtctcaagcatatgtgcatctataaac

SEQ ID NO: 49777 - DNA, 479 bp, Homo sapiens
caaaaggtggctaaagagcctaagtggagatctgcttgtattcttcattgatgaagtctaaatatgaagctagaactgaagacattccatcagattgactgttacagggtagggagctgcagcacaagcacagagaagccagcagcttcatcacatcacaccagctctgcagcgccaaggcagacacaccagctctgcggcaccgaggcagacacaccagctctgcggtgccgaggcagagcctgcgccctctgatgctctgtgtcgtgttttttcccacttcgccatgctgcattttccttagggctctgacatctccttctgacactgattttttttttttgacactgaatttttaaataattatttttcaaggtgcaacattttgacgtcaaaattcagctagtgagatttccaaagtccctttcttctaatttcttatttccaagtattttttttaattgcagcttaatttatga

SEQ ID NO: 49778 - DNA, 633 bp, Homo sapiens
tcacattgagtaggccgagaaggaagagaaagaaaaggagtcagtcttactgtctcagggttatcacaggtgggaggaaatccacatataagtatcacaggtgggaggaaatccacatataagtagaccttaacaattcatacccatgttgctcaagggtcaactataatgtccttggcttgctacagataaacatcctcaggacaggattctacacctgggcagtgctagggcataaactgccctggcttccagggagctgactgccagtagtctgcccgtgtttgcccagatgcacttattgtttctccagcaccacagccccatagcaggaccacatggaggaataggcaaagccacccttttcccaatgcccagggaagctgggatcagagagactaagagaactctcacaccaggaatatcagcagtaaccagggcagaagcaggaaacagagaacacaattctattgtcaaactcatcccataagcactagagggcataggtgatggtggttttaaattgcacaaaggaacacattcctatacttgatagagttaaaagcagagcttattaacataattctcctacattttaattttgaaaatcccatttaaagctacatctgattt

SEQ ID NO: 49779 - DNA, 564 bp, Homo sapiens
tccaaggggtaaagtgtgaaccccccgatgctttattctctctctctccccattacctggcccagatatggatgcagttgtgggaagcgtgtggctagagaaccagaaaaggggagacccaggaaactagaaagtactggggggattgccagagaggaggagctcaggaaggtaacccctttaaggtgttaatgaactcccagacttcctcgtcatgttgtgggtacccagatctgacgctgagtagcttacgtagacttggagaactcatctctgggatagaccaccatgcagttccctaactggccactggatggtgcacaggcaggatggatccaaaaagcgcttcaaaggctttgaaaacagctgacttgggaaccacaactcacagaaggctggctggaacttgtgtgtggaatctaactgcataaattgcttactaagataaaaacgtcaacattctcccaagggttgagagaaaattcagagtttcttaacacaatattgaaaatgtctagaatgcagttcaaaattaattggcttaagaactagaatcatctttaa

SEQ ID NO: 49780 - DNA, 154 bp, Homo sapiens
tgcaggcccagagaaggaagaggaaggcatgtaaacagataaacggcaggcagtgcggagtgatgaatgatgggtgctccagcagaagagacagtagaagtggcatctgagccaggcctcaacacgcagggagtacgggcatcctaggcaaagg

SEQ ID NO: 49781 - DNA, 168 bp, Homo sapiens
ctaggagaacttcacaggaagaagccgagaagttgtggaagctgctgtttctcatgaaaagccagggctggcttcctcaggaaggaagtgtgcggcgaatcctgtgtgcagacccctgctgccaaatctgcaatgttatggctctggagattaagcaattgctggcag

SEQ ID NO: 49782 - DNA, 306 bp, Homo sapiens
acacaacttagcaattatgctatgtaatcaatcacatattgtaacagtccaatatttcttagtctattcatacttactagaatattcctcaagctttattttgataattcaaaatttcctgacttattctgaatttctacatctatgaaagacatacccatgtggtgcttaccattcatgtttaaatatttaacttgatgataagataattaatacttaatatttgctatgattaacttactctgacaattaaatgatttataaaaggttcttttaacaacatatcatttgtcataggcttggaaa

SEQ ID NO: 49783 - DNA, 291 bp, Homo sapiens
cagggccctaaggccccgtcagacaatccctctgtcctcggcagttttcagtgagctaagagtccttgactgctttggtgtgtaaatcggtaggatactgaggaaactgacaccttcctctctggcctctctggggatctttgtatcaatgtgggcccaggtgcccagtgtgttgggaggtatgagaggagcagagaaccgggatgtgactctcaggagcttatagcctgctggggaaggcaaggctgttgcactcagacaattggctgttcattaaatgcccagacacat

SEQ ID NO: 49784 - DNA, 467 bp, Homo sapiens
acattccaatacgtaccatttttctactacaaagtgaaaaaaatgaaaggaaatacgacaagccctatggaaaagtacttcaaaagtgtcttctacaaaaataccattactcgtagcatattaaattttacatctactaaaaattatcagctatctgaaagtactaatcaaaactaaatatttaaaaaaattaaataccccatttccattattttggtcccatgagaatatttctacttttatatgccaatacattctaaaaagagtccccttcaaaaatgtattttgtagacatctgtattgatttttatatggtatagggtaacatttcacaataataaaaatattttctaggcgtggtggctcacatctgtaatgccagcactctgggagcctgaggagggaggaacacttgagcccaggagttcaagaccagcctgggcaacatagggagaccttgtatctac

SEQ ID NO: 49785 - DNA, 635 bp, Homo sapiens
gatgaacccagtacctcagatggaaatgcagaaatcacccgtcttctgtgttgcttactctgggagctgtagaccggagctgttcctattcggccatcttggctgccagcttctttgtgtagtttcattaccacttgagatgcaattaaatttgttttagttttcagtttgagggaatttgtttttctttttagttcaactttagtttttgagtatgtataattttaagcagcattaatagagtataatcttttcaacactgcccaaaacatgacacatctagaataatctgtttacttctttttgccatattttaggaatggccagcccagtatcaagggtgggatgatacgagtggtttatcctggatctggatggcaataaggggatatattgtctatgtctgtaaagaatttcaaaactataataaaactaacaagattttgtctgggtttttattctcaccatgcaccagcaattctcaatactaccagtgagaaagtacttctccctccactgagtgtgttgctaagaagcttattaagcagtttgagtatccaaaggagagtaataagactgacgaggaatctgaaaaccatagcccatgagagatgaacagattttaatatcaatca

SEQ ID NO: 49786 - DNA, 377 bp, Homo sapiens
gcctgtaaggaggtgatgataaaggttaaataagataaggttggggcctaatccaatagggctggttcctttataagaagaggaagacaccagatcttttttctacactgtgggaagacacagcaacaacatggccatctgtaagccacgaagagagctctcaccaggaactgatggatagcacctggatcttggactgctcagataggtttatacgatctagtctgtggtattcagtagcccaagctgactaatataatggctgtgtgtgtacaaatagcttttcaagattttttacaattcttttatacagtgggaaaactgtattctatttatacccagaaatagaattgctagaacatgtagtagttctattt

SEQ ID NO: 49787 - DNA, 738 bp, Homo sapiens
caaaagagaaagccactttcctagtctttgttgaatggtaaatgttccttcaagagttgcaggaagagcatgccttgcttgcgccatggggtggggctgcaccatcttgcttgctgcgtgtgcttgtattgttcatcatacacaattcatggtttcttttcaggaatttttgaagtcgcttgtccattctatgaaggttagtttggttaaaattaaagcattttaactgagtacttacaaactgtagtagacccagataggctgaaagcaaaagtaggatggagggcttggcttcggtgaggaccaagcctcttctgtcagccactcctgtgcgactgttcaggcccaggggatccactcagggaaggtacctgtgtcaacctcaatattaactgttatcaaagcttcctgtctcttttattttagcccagaagcaatacttttaatggattcccttcccacgtcccaaatggatcatgtgtacccctcccgggcacccaccggaagactctgggtattgtgtgcgttgtccgcctcagtgacgaggatcttcataactttccttcctgcaaaaaggaacattagttttcagtgtttccaacaattatccagcaataccatctaaacaccattttctgtattctaggagcaagctgaagaggaaaagaagcccaaggatagcacaacccctttgagtcacggtaattatcaccaatatttacagtggtagttcacagt

SEQ ID NO: 49788 - DNA, 7606 bp, Homo sapiens
gttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa

SEQ ID NO: 49789 - DNA, 397 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcagtgagtactctctgagcgttggtgcct

SEQ ID NO: 49790 - DNA, 7706 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa

SEQ ID NO: 49791 - DNA, 6461 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgatggtgccaggggcagaaatggccctggctcttttccaatcaaaggtga

SEQ ID NO: 49792 - DNA, 5053 bp, Homo sapiens
cagaagtctctgtctccatcttcaaactgtcgatgtgagcaatggagatgaccgtagcagctacataccacggaagagccatgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa

SEQ ID NO: 49793 - DNA, 3585 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa

SEQ ID NO: 49794 - DNA, 603 bp, Homo sapiens
gtgaattcaaatcacatattgcagtcactttaagagatttttttatagttacgttgggtttatacgctatccttgaggtattatttacatgatatcaacacctttgttgttttagccaaacattgattttgtcaatgtgtagtttttttgaaggtgaaaagacaagagcatgtttatgaagacaagaggtagattggtaatcttttgatttggtttcagggaacaaagagtcactggaacccttgtgtttattctgactggtctgtcagtctttatggctcccatcttgaaggtaaatatgtgaaacattcacctcttccttctcagaacactgacatataattggacatgtgaagagtgaaattcctcatgagatatttgcgagattctcatcagttctgtaacacactgaagcaggggtcaagtagaaagagagctttaaatagcttttgtcttgatttccttctcactctttcatcccctcccttatccttagttttgcagttatttgattgaactatattaaattaacaatatccaaactttctgatctgtgaaaatagtagtttcatgcaattgaatcagactgatcttctccccctc

SEQ ID NO: 49795 - DNA, 200 bp, Homo sapiens
gcggcggcggccgcggtggcagcgaaggcggcggcggcggcggcagtggcagtggccgctgcagccccacactccgccgccaaactggaggagcgacggaagccagaccccaggagggtttagaggaagagtttgggtggtctgcttctccctcactgctaagtcccctgcgcgcaactgggcgtctttacgaggactgc

SEQ ID NO: 49796 - DNA, 7633 bp, Homo sapiens
aggagaagtctgagcattctttttttcttttttattactataggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccggatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaaatatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcatttatgactgtcaaaaa
